US009505804B2

(12) United States Patent
Guerlavais et al.

(10) Patent No.: US 9,505,804 B2
(45) Date of Patent: *Nov. 29, 2016

(54) PEPTIDOMIMETIC MACROCYCLES

(71) Applicant: Aileron Therapeutics, Cambridge, MA (US)

(72) Inventors: Vincent Guerlavais, Arlington, MA (US); Carl Elkin, Arlington, MA (US); Huw M. Nash, Lexington, MA (US); Tomi K. Sawyer, Southborough, MA (US); Bradford J. Graves, Nutley, NJ (US); Eric Feyfant, Lexington, MA (US)

(73) Assignee: AILERON THERAPEUTICS, INC., Cambridge, MA (US)

( * ) Notice: Subject to any disclaimer, the term of this patent is extended or adjusted under 35 U.S.C. 154(b) by 0 days.

This patent is subject to a terminal disclaimer.

(21) Appl. No.: 14/498,063

(22) Filed: Sep. 26, 2014

(65) Prior Publication Data

US 2015/0051155 A1 Feb. 19, 2015

Related U.S. Application Data

(63) Continuation of application No. 13/767,852, filed on Feb. 14, 2013, now Pat. No. 8,927,500.

(60) Provisional application No. 61/599,328, filed on Feb. 15, 2012, provisional application No. 61/656,962, filed on Jun. 7, 2012, provisional application No. 61/723,770, filed on Nov. 7, 2012.

(51) Int. Cl.
| | |
|---|---|
| *C07K 1/113* | (2006.01) |
| *C07K 7/54* | (2006.01) |
| *C07K 7/64* | (2006.01) |
| *C07K 14/47* | (2006.01) |
| *C07K 7/08* | (2006.01) |
| *A61K 38/10* | (2006.01) |
| *A61K 38/12* | (2006.01) |
| *A61K 38/03* | (2006.01) |
| *C07K 7/06* | (2006.01) |
| *A61K 38/08* | (2006.01) |

(52) U.S. Cl.
CPC ............... *C07K 7/08* (2013.01); *A61K 38/03* (2013.01); *A61K 38/08* (2013.01); *C07K 1/113* (2013.01); *C07K 7/06* (2013.01); *C07K 7/54* (2013.01); *C07K 14/4746* (2013.01); *A61K 38/10* (2013.01); *A61K 38/12* (2013.01)

(58) Field of Classification Search
None
See application file for complete search history.

(56) References Cited

U.S. PATENT DOCUMENTS

| | | |
|---|---|---|
| 4,000,259 A | 12/1976 | Garsky |
| 4,191,754 A | 3/1980 | Nutt et al. |
| 4,270,537 A | 6/1981 | Romaine |
| 4,438,270 A | 3/1984 | Bey et al. |
| 4,596,556 A | 6/1986 | Morrow et al. |
| 4,683,195 A | 7/1987 | Mullis et al. |
| 4,683,202 A | 7/1987 | Mullis |
| 4,730,006 A | 3/1988 | Bohme et al. |
| 4,737,465 A | 4/1988 | Bond et al. |
| 4,790,824 A | 12/1988 | Morrow et al. |
| 4,886,499 A | 12/1989 | Cirelli et al. |
| 4,940,460 A | 7/1990 | Casey et al. |
| 4,941,880 A | 7/1990 | Burns |
| 5,015,235 A | 5/1991 | Crossman |
| 5,064,413 A | 11/1991 | McKinnon et al. |
| 5,120,859 A | 6/1992 | Webb |
| 5,141,496 A | 8/1992 | Dalto et al. |
| 5,190,521 A | 3/1993 | Hubbard et al. |
| 5,245,009 A | 9/1993 | Kornreich et al. |
| 5,310,910 A | 5/1994 | Drtina et al. |
| 5,312,335 A | 5/1994 | McKinnon et al. |
| 5,323,907 A | 6/1994 | Kalvelage |
| 5,328,483 A | 7/1994 | Jacoby |
| 5,334,144 A | 8/1994 | Alchas et al. |
| 5,339,163 A | 8/1994 | Homma et al. |
| 5,364,851 A | 11/1994 | Joran |
| 5,383,851 A | 1/1995 | McKinnon et al. |
| 5,417,662 A | 5/1995 | Hjertman et al. |
| 5,446,128 A | 8/1995 | Kahn |
| 5,466,220 A | 11/1995 | Brenneman |
| 5,480,381 A | 1/1996 | Weston |

(Continued)

FOREIGN PATENT DOCUMENTS

| | | |
|---|---|---|
| CN | 1252808 A | 5/2000 |
| CZ | 9700369 A3 | 9/1998 |

(Continued)

OTHER PUBLICATIONS

U.S. Appl. No. 13/494,846, filed Jun. 12, 2012, Nash et al.
U.S. Appl. No. 13/680,905, filed Nov. 19, 2012, Verdine et al.
U.S. Appl. No. 13/767,857, filed Feb. 14, 2013, Guerlavais et al.
U.S. Appl. No. 13/816,880, filed Feb. 13, 2013, Guerlavais et al.
U.S. Appl. No. 13/957,667, filed Aug. 2, 2013, Nash et al.
U.S. Appl. No. 14/068,844, filed Oct. 31, 2013, Verdine et al.

(Continued)

*Primary Examiner* — Jeffrey E Russel
(74) *Attorney, Agent, or Firm* — Wilson, Sonsini, Goodrich & Rosati, PC

(57) ABSTRACT

Provided herein are peptidomimetic macrocycles containing amino acid sequences with at least two modified amino acids that form an intramolecular cross-link that can help to stabilize a secondary structure of the amino acid sequence. Suitable sequences for stabilization include those with homology to the p53 protein. These sequences can bind to the MDM2 and/or MDMX proteins. Also provided herein are methods of using such macrocycles for the treatment of diseases and disorders, such as cancers or other disorders characterized by a low level or low activity of a p53 protein or high level of activity of a MDM2 and/or MDMX protein.

71 Claims, 7 Drawing Sheets

(56) References Cited

U.S. PATENT DOCUMENTS

| | | |
|---|---|---|
| 5,503,627 A | 4/1996 | McKinnon et al. |
| 5,520,639 A | 5/1996 | Peterson et al. |
| 5,527,288 A | 6/1996 | Gross et al. |
| 5,569,189 A | 10/1996 | Parsons |
| 5,599,302 A | 2/1997 | Lilley et al. |
| 5,622,852 A | 4/1997 | Korsmeyer |
| 5,649,912 A | 7/1997 | Peterson |
| 5,650,133 A | 7/1997 | Carvalho et al. |
| 5,663,316 A | 9/1997 | Xudong |
| 5,672,584 A | 9/1997 | Borchardt et al. |
| 5,702,908 A | 12/1997 | Picksley et al. |
| 5,704,911 A | 1/1998 | Parsons |
| 5,708,136 A | 1/1998 | Burrell et al. |
| 5,731,408 A | 3/1998 | Hadley et al. |
| 5,750,767 A | 5/1998 | Carpino et al. |
| 5,756,669 A | 5/1998 | Bischoff et al. |
| 5,770,377 A | 6/1998 | Picksley et al. |
| 5,811,515 A | 9/1998 | Grubbs et al. |
| 5,817,752 A | 10/1998 | Yu |
| 5,817,789 A | 10/1998 | Heartlein et al. |
| 5,824,483 A | 10/1998 | Houston, Jr. et al. |
| 5,834,209 A | 11/1998 | Korsmeyer |
| 5,837,845 A | 11/1998 | Hosokawa et al. |
| 5,840,833 A | 11/1998 | Kahn |
| 5,856,445 A | 1/1999 | Korsmeyer |
| 5,859,184 A | 1/1999 | Kahn et al. |
| 5,874,529 A | 2/1999 | Gilon et al. |
| 5,893,397 A | 4/1999 | Peterson et al. |
| 5,922,863 A | 7/1999 | Grubbs et al. |
| 5,955,593 A | 9/1999 | Korsmeyer |
| 5,965,703 A | 10/1999 | Horne et al. |
| 5,993,412 A | 11/1999 | Deily et al. |
| 5,998,583 A | 12/1999 | Korsmeyer |
| 6,030,997 A | 2/2000 | Eilat et al. |
| 6,031,073 A | 2/2000 | Yu |
| 6,043,339 A | 3/2000 | Lin et al. |
| 6,046,289 A | 4/2000 | Komazawa et al. |
| 6,051,554 A | 4/2000 | Hornik et al. |
| 6,054,556 A | 4/2000 | Huby et al. |
| 6,118,010 A | 9/2000 | Ueda et al. |
| 6,153,391 A | 11/2000 | Picksley et al. |
| 6,169,073 B1 | 1/2001 | Halazonetis et al. |
| 6,177,076 B1 | 1/2001 | Lattime et al. |
| 6,177,542 B1 | 1/2001 | Ruoslahti et al. |
| 6,184,344 B1 | 2/2001 | Kent et al. |
| 6,204,361 B1 | 3/2001 | Carpino et al. |
| 6,245,886 B1 | 6/2001 | Halazonetis et al. |
| 6,271,198 B1 | 8/2001 | Braisted et al. |
| 6,287,787 B1 | 9/2001 | Houghten et al. |
| 6,326,354 B1 | 12/2001 | Gross et al. |
| 6,348,558 B1 | 2/2002 | Harris et al. |
| 6,420,118 B1 | 7/2002 | Halazonetis et al. |
| 6,420,136 B1 | 7/2002 | Riabowol et al. |
| 6,444,425 B1 | 9/2002 | Reed et al. |
| 6,495,674 B1 | 12/2002 | Lemke et al. |
| 6,514,685 B1 | 2/2003 | Moro |
| 6,569,993 B1 | 5/2003 | Sledeski et al. |
| 6,572,856 B1 | 6/2003 | Taylor et al. |
| 6,610,657 B1 | 8/2003 | Goueli |
| 6,613,874 B1 | 9/2003 | Mazur et al. |
| 6,686,148 B1 | 2/2004 | Shen et al. |
| 6,703,382 B2 | 3/2004 | Wang et al. |
| 6,713,280 B1 | 3/2004 | Huang et al. |
| 6,784,157 B2 | 8/2004 | Halazonetis et al. |
| 6,849,428 B1 | 2/2005 | Evans et al. |
| 6,875,594 B2 | 4/2005 | Muir et al. |
| 7,064,193 B1 | 6/2006 | Cory et al. |
| 7,083,983 B2 | 8/2006 | Lane et al. |
| 7,084,244 B2 | 8/2006 | Gilon et al. |
| 7,115,372 B2 | 10/2006 | Shen et al. |
| 7,183,059 B2 | 2/2007 | Verdine et al. |
| 7,189,801 B2 | 3/2007 | Halazonetis et al. |
| 7,192,713 B1 | 3/2007 | Verdine et al. |
| 7,202,332 B2 | 4/2007 | Arora et al. |
| 7,247,700 B2 | 7/2007 | Korsmeyer et al. |
| 7,538,190 B2 | 5/2009 | Robinson et al. |
| 7,666,983 B2 | 2/2010 | Halazonetis et al. |
| 7,705,118 B2 | 4/2010 | Arora et al. |
| 7,723,469 B2 | 5/2010 | Walensky et al. |
| 7,737,174 B2 | 6/2010 | Wang et al. |
| 7,745,573 B2 | 6/2010 | Robinson et al. |
| 7,759,383 B2 | 7/2010 | Wang et al. |
| 7,786,072 B2 | 8/2010 | Verdine et al. |
| 7,884,107 B2 | 2/2011 | Ma et al. |
| 7,893,278 B2 | 2/2011 | Haley et al. |
| 7,927,813 B2 | 4/2011 | Geneste et al. |
| 7,932,397 B2 | 4/2011 | Hock et al. |
| 7,960,506 B2 | 6/2011 | Nash et al. |
| 7,964,724 B2 | 6/2011 | Fotouhi et al. |
| 7,981,998 B2 | 7/2011 | Nash |
| 7,981,999 B2 | 7/2011 | Nash |
| 8,017,607 B2 | 9/2011 | Bartkovitz et al. |
| 8,058,269 B2 | 11/2011 | Chen et al. |
| 8,071,541 B2 | 12/2011 | Arora et al. |
| 8,076,482 B2 | 12/2011 | Chen et al. |
| 8,088,815 B2 | 1/2012 | Bartkovitz et al. |
| 8,088,931 B2 | 1/2012 | Wang et al. |
| 8,124,726 B2 | 2/2012 | Robinson et al. |
| 8,198,405 B2 | 6/2012 | Walensky et al. |
| 8,217,051 B2 | 7/2012 | Zhang et al. |
| 8,324,428 B2 | 12/2012 | Verdine et al. |
| 8,343,760 B2 | 1/2013 | Lu et al. |
| 8,389,484 B2 | 3/2013 | Shen et al. |
| 8,399,405 B2 | 3/2013 | Nash et al. |
| 8,524,653 B2 | 9/2013 | Nash et al. |
| 8,592,377 B2 | 11/2013 | Verdine et al. |
| 8,609,809 B2 | 12/2013 | Nash |
| 8,637,686 B2 | 1/2014 | Nash |
| 8,796,418 B2 | 8/2014 | Walensky et al. |
| 8,808,694 B2 | 8/2014 | Nash et al. |
| 8,859,723 B2 * | 10/2014 | Guerlavais et al. ......... 530/321 |
| 8,871,899 B2 | 10/2014 | Wang et al. |
| 8,889,632 B2 | 11/2014 | Bernal et al. |
| 8,895,699 B2 | 11/2014 | Verdine et al. |
| 8,927,500 B2 * | 1/2015 | Guerlavais et al. ......... 514/18.9 |
| 8,957,026 B2 | 2/2015 | Verdine et al. |
| 8,987,414 B2 * | 3/2015 | Guerlavais et al. ......... 530/321 |
| 9,096,684 B2 | 8/2015 | Kawahata et al. |
| 9,163,330 B2 | 10/2015 | Verdine et al. |
| 9,175,045 B2 | 11/2015 | Nash et al. |
| 9,175,047 B2 | 11/2015 | Nash et al. |
| 9,175,056 B2 | 11/2015 | Nash |
| 9,206,223 B2 | 12/2015 | Nash et al. |
| 9,273,099 B2 | 3/2016 | Walensky et al. |
| 2002/0098580 A1 | 7/2002 | Nandabalan et al. |
| 2002/0132977 A1 | 9/2002 | Yuan et al. |
| 2003/0027766 A1 | 2/2003 | Ioannides et al. |
| 2003/0060432 A1 | 3/2003 | Tocque et al. |
| 2003/0144331 A1 | 7/2003 | Gudkov et al. |
| 2003/0166138 A1 | 9/2003 | Kinsella et al. |
| 2003/0176318 A1 | 9/2003 | Gudkov et al. |
| 2004/0023887 A1 | 2/2004 | Pillutla et al. |
| 2004/0038901 A1 | 2/2004 | Basler et al. |
| 2004/0067503 A1 | 4/2004 | Tan et al. |
| 2004/0106159 A1 | 6/2004 | Kern et al. |
| 2004/0106548 A1 | 6/2004 | Schmidt et al. |
| 2004/0115135 A1 | 6/2004 | Quay |
| 2004/0146971 A1 | 7/2004 | Lane et al. |
| 2004/0152708 A1 | 8/2004 | Li et al. |
| 2004/0170653 A1 | 9/2004 | Stanislawski et al. |
| 2004/0170971 A1 | 9/2004 | Kinzler et al. |
| 2004/0171809 A1 | 9/2004 | Korsmeyer et al. |
| 2004/0228866 A1 | 11/2004 | Lu |
| 2004/0235746 A1 | 11/2004 | Hawiger et al. |
| 2004/0248198 A1 | 12/2004 | Kriwacki et al. |
| 2004/0265931 A1 | 12/2004 | Gu et al. |
| 2005/0013820 A1 | 1/2005 | Holoshitz et al. |
| 2005/0037383 A1 | 2/2005 | Taremi et al. |
| 2005/0089511 A1 | 4/2005 | Roth et al. |
| 2005/0119167 A1 | 6/2005 | Abbenante et al. |
| 2005/0137137 A1 | 6/2005 | Lane et al. |
| 2005/0176075 A1 | 8/2005 | Jones et al. |
| 2005/0222224 A1 | 10/2005 | Gudkov et al. |
| 2005/0222427 A1 | 10/2005 | Sharpless et al. |

(56) References Cited

U.S. PATENT DOCUMENTS

| | | |
|---|---|---|
| 2005/0227932 A1 | 10/2005 | Lu et al. |
| 2005/0245764 A1 | 11/2005 | Yamashita et al. |
| 2005/0250680 A1 | 11/2005 | Walensky et al. |
| 2005/0277764 A1 | 12/2005 | Boyd et al. |
| 2006/0008848 A1 | 1/2006 | Verdine et al. |
| 2006/0014675 A1 | 1/2006 | Arora et al. |
| 2006/0073518 A1 | 4/2006 | Timmerman et al. |
| 2006/0100143 A1 | 5/2006 | Lu et al. |
| 2006/0111411 A1 | 5/2006 | Cooper et al. |
| 2006/0148715 A1 | 7/2006 | Tweardy |
| 2006/0149039 A1 | 7/2006 | Hunter et al. |
| 2006/0189511 A1 | 8/2006 | Koblish et al. |
| 2006/0233779 A1 | 10/2006 | Ben-Avraham et al. |
| 2006/0293380 A1 | 12/2006 | Nantermet et al. |
| 2007/0006332 A1 | 1/2007 | O'Neil |
| 2007/0020620 A1 | 1/2007 | Finn et al. |
| 2007/0032417 A1 | 2/2007 | Baell |
| 2007/0129324 A1 | 6/2007 | Boyd et al. |
| 2007/0161544 A1 | 7/2007 | Wipf et al. |
| 2007/0274915 A1 | 11/2007 | Rao et al. |
| 2008/0081038 A1 | 4/2008 | Cho et al. |
| 2008/0085279 A1 | 4/2008 | Boyd et al. |
| 2008/0132485 A1 | 6/2008 | Wang et al. |
| 2008/0161426 A1 | 7/2008 | Gudkov et al. |
| 2008/0213175 A1 | 9/2008 | Kolb et al. |
| 2008/0234183 A1 | 9/2008 | Hallbrink et al. |
| 2008/0242598 A1 | 10/2008 | Fairlie et al. |
| 2008/0250515 A1 | 10/2008 | Reed |
| 2008/0262200 A1 | 10/2008 | Nash |
| 2008/0305490 A1 | 12/2008 | Burrell et al. |
| 2008/0311608 A1 | 12/2008 | Tocque et al. |
| 2009/0047711 A1 | 2/2009 | Nash |
| 2009/0088553 A1 | 4/2009 | Nash |
| 2009/0149630 A1 | 6/2009 | Walensky et al. |
| 2009/0176964 A1 | 7/2009 | Walensky et al. |
| 2009/0275519 A1 | 11/2009 | Nash et al. |
| 2009/0311174 A1 | 12/2009 | Allen |
| 2009/0326192 A1 | 12/2009 | Nash et al. |
| 2010/0010065 A1 | 1/2010 | Smith |
| 2010/0081611 A1 | 4/2010 | Bradner et al. |
| 2010/0093057 A1 | 4/2010 | Beattie et al. |
| 2010/0093086 A1 | 4/2010 | Lin et al. |
| 2010/0168388 A1 | 7/2010 | Bernal et al. |
| 2010/0184628 A1 | 7/2010 | Nash |
| 2010/0184645 A1 | 7/2010 | Verdine et al. |
| 2010/0210515 A1 | 8/2010 | Nash et al. |
| 2010/0216688 A1 | 8/2010 | Nash et al. |
| 2010/0234563 A1 | 9/2010 | Arora et al. |
| 2010/0273704 A1 | 10/2010 | Korsmeyer et al. |
| 2010/0286362 A1 | 11/2010 | Boyd et al. |
| 2010/0298201 A1 | 11/2010 | Nash et al. |
| 2011/0021529 A1 | 1/2011 | Lain et al. |
| 2011/0028753 A1 | 2/2011 | Verdine et al. |
| 2011/0046043 A1 | 2/2011 | Wang et al. |
| 2011/0065915 A1 | 3/2011 | Malcolmson et al. |
| 2011/0144303 A1 | 6/2011 | Nash et al. |
| 2011/0144306 A1 | 6/2011 | Verdine et al. |
| 2011/0183917 A1 | 7/2011 | Lu et al. |
| 2011/0218155 A1 | 9/2011 | Walensky et al. |
| 2011/0223149 A1 | 9/2011 | Nash et al. |
| 2011/0245175 A1 | 10/2011 | Arora et al. |
| 2011/0245477 A1 | 10/2011 | Hoveyda et al. |
| 2011/0250685 A1 | 10/2011 | Nash |
| 2011/0251252 A1 | 10/2011 | Wang et al. |
| 2011/0263815 A1 | 10/2011 | Nash |
| 2011/0313167 A1 | 12/2011 | Doemling |
| 2012/0040889 A1 | 2/2012 | Nash et al. |
| 2012/0082636 A1 | 4/2012 | Walensky et al. |
| 2012/0101047 A1 | 4/2012 | Nash et al. |
| 2012/0115783 A1 | 5/2012 | Nash et al. |
| 2012/0115793 A1 | 5/2012 | Nash et al. |
| 2012/0156197 A1 | 6/2012 | Errico et al. |
| 2012/0172311 A1 | 7/2012 | Nash et al. |
| 2012/0178700 A1 | 7/2012 | Nash et al. |
| 2012/0190818 A1 | 7/2012 | Nash et al. |
| 2012/0238507 A1 | 9/2012 | Fairlie et al. |
| 2012/0264674 A1 | 10/2012 | Nash et al. |
| 2012/0264738 A1 | 10/2012 | Sugimoto et al. |
| 2012/0270800 A1 | 10/2012 | Verdine et al. |
| 2012/0283269 A1 | 11/2012 | Blagosklonny et al. |
| 2012/0328692 A1 | 12/2012 | Lu et al. |
| 2013/0005943 A1 | 1/2013 | Arora et al. |
| 2013/0023646 A1 | 1/2013 | Nash et al. |
| 2013/0072439 A1 | 3/2013 | Nash et al. |
| 2013/0123196 A1 | 5/2013 | Arora et al. |
| 2013/0177979 A1 | 7/2013 | Turkson |
| 2013/0210743 A1 | 8/2013 | Guerlavais et al. |
| 2013/0211046 A1 | 8/2013 | Verdine et al. |
| 2013/0274205 A1 | 10/2013 | Guerlavais et al. |
| 2013/0330421 A1 | 12/2013 | Marine |
| 2014/0005118 A1 | 1/2014 | Verdine et al. |
| 2014/0011979 A1 | 1/2014 | Verdine et al. |
| 2014/0018302 A1 | 1/2014 | Walensky et al. |
| 2014/0051828 A1 | 2/2014 | Arora et al. |
| 2014/0128581 A1 | 5/2014 | Darlak et al. |
| 2014/0135473 A1 | 5/2014 | Nash |
| 2014/0162339 A1 | 6/2014 | Verdine et al. |
| 2014/0235549 A1 | 8/2014 | Moellering et al. |
| 2014/0256912 A1 | 9/2014 | Moellering et al. |
| 2014/0296160 A1 | 10/2014 | Walensky et al. |
| 2015/0056612 A1 | 2/2015 | Shen et al. |
| 2015/0183825 A1 | 7/2015 | Guerlavais et al. |

FOREIGN PATENT DOCUMENTS

| | | |
|---|---|---|
| EP | 0528312 A2 | 2/1993 |
| EP | 0552417 A1 | 7/1993 |
| EP | 0729972 A1 | 9/1996 |
| EP | 0643726 B1 | 8/1999 |
| EP | 0977580 B1 | 4/2003 |
| EP | 1321474 A1 | 6/2003 |
| EP | 1609802 A1 | 12/2005 |
| EP | 1243923 B1 | 3/2006 |
| EP | 1180016 B1 | 9/2006 |
| EP | 0958305 B1 | 6/2008 |
| EP | 2377849 A2 | 10/2011 |
| JP | 2002-524391 | 8/2002 |
| JP | 2010/120881 A | 6/2010 |
| WO | WO 92/06998 A1 | 4/1992 |
| WO | WO 93/07170 A1 | 4/1993 |
| WO | WO 94/22910 A1 | 10/1994 |
| WO | WO 95/22546 A1 | 8/1995 |
| WO | WO 96/34878 A1 | 11/1996 |
| WO | WO 97/13537 A1 | 4/1997 |
| WO | WO 97/14794 A1 | 4/1997 |
| WO | WO 97/37705 A1 | 10/1997 |
| WO | WO-9801467 A2 | 1/1998 |
| WO | WO 98/17625 A1 | 4/1998 |
| WO | WO 99/34850 A1 | 7/1999 |
| WO | WO 99/63929 A2 | 12/1999 |
| WO | WO 00/06187 A2 | 2/2000 |
| WO | WO 00/06187 A3 | 5/2000 |
| WO | WO 02/064790 A2 | 8/2002 |
| WO | WO 02/070547 A1 | 9/2002 |
| WO | WO 02/064790 A3 | 5/2003 |
| WO | WO 03/054000 A1 | 7/2003 |
| WO | WO 03/102538 A2 | 12/2003 |
| WO | WO 03/106491 A2 | 12/2003 |
| WO | WO 2004/041275 A1 | 5/2004 |
| WO | WO 2004/058804 A1 | 7/2004 |
| WO | WO 03/106491 A3 | 12/2004 |
| WO | WO 2005/040202 A2 | 5/2005 |
| WO | WO 2005/044839 A2 | 5/2005 |
| WO | WO 2005/040202 A3 | 6/2005 |
| WO | WO 2005/044839 A3 | 7/2005 |
| WO | WO 2005/074521 A2 | 8/2005 |
| WO | WO 2005/085457 A2 | 9/2005 |
| WO | WO 2005/090388 A1 | 9/2005 |
| WO | WO 2005/118620 A2 | 12/2005 |
| WO | WO 2005/118634 A2 | 12/2005 |
| WO | WO 2005/118634 A3 | 5/2006 |
| WO | WO 2005/118620 A3 | 6/2006 |
| WO | WO 2006/103666 A2 | 10/2006 |
| WO | WO 2006/103666 A3 | 3/2007 |

(56) References Cited

FOREIGN PATENT DOCUMENTS

| WO | WO 2007/141533 A2 | 12/2007 |
|---|---|---|
| WO | WO 2008/014216 A1 | 1/2008 |
| WO | WO 2008/045238 A2 | 4/2008 |
| WO | WO 2008/061192 A2 | 5/2008 |
| WO | WO 2007/141533 A3 | 7/2008 |
| WO | WO 2008/061192 A3 | 7/2008 |
| WO | WO 2008/092281 A1 | 8/2008 |
| WO | WO 2008/095063 A1 | 8/2008 |
| WO | WO 2008/104000 A2 | 8/2008 |
| WO | WO 2008/106507 A2 | 9/2008 |
| WO | WO 2008/121767 A2 | 10/2008 |
| WO | WO 2008/121767 A3 | 1/2009 |
| WO | WO-2009126292 A2 | 10/2009 |
| WO | WO 2009/137532 A1 | 11/2009 |
| WO | WO-2009149339 A2 | 12/2009 |
| WO | WO 2010/011313 A2 | 1/2010 |
| WO | WO 2010/013011 A1 | 2/2010 |
| WO | WO-2010034026 A1 | 3/2010 |
| WO | WO-2010034028 A1 | 3/2010 |
| WO | WO-2010034029 A1 | 3/2010 |
| WO | WO-2010034034 A1 | 3/2010 |
| WO | WO 2010/058819 A1 | 5/2010 |
| WO | WO-2010068684 A2 | 6/2010 |
| WO | WO 2010/083501 A2 | 7/2010 |
| WO | WO 2010/100351 A1 | 9/2010 |
| WO | WO 2010/107485 A1 | 9/2010 |
| WO | WO 2010/011313 A3 | 12/2010 |
| WO | WO 2011/005219 A1 | 1/2011 |
| WO | WO 2011/008260 A2 | 1/2011 |
| WO | WO 2011/008260 A3 | 3/2011 |
| WO | WO 2011/023677 A1 | 3/2011 |
| WO | WO 2011/060049 A2 | 5/2011 |
| WO | WO 2011/061139 A1 | 5/2011 |
| WO | WO 2011/076786 A1 | 6/2011 |
| WO | WO 2011/090297 A2 | 7/2011 |
| WO | WO 2011/101297 A1 | 8/2011 |
| WO | WO 2011/106650 A2 | 9/2011 |
| WO | WO 2011/161699 A2 | 12/2011 |
| WO | WO 2012/016186 A1 | 2/2012 |
| WO | WO 2012/021876 A2 | 2/2012 |
| WO | WO-2012021874 A1 | 2/2012 |
| WO | WO-2012021875 A1 | 2/2012 |
| WO | WO 2012/033525 A2 | 3/2012 |
| WO | WO 2012/034954 A1 | 3/2012 |
| WO | WO 2012/038307 A1 | 3/2012 |
| WO | WO 2012/040459 A2 | 3/2012 |
| WO | WO 2012/045018 A1 | 4/2012 |
| WO | WO 2012/047587 A2 | 4/2012 |
| WO | WO 2012/051405 A1 | 4/2012 |
| WO | WO 2012/059696 A1 | 5/2012 |
| WO | WO 2012/065022 A2 | 5/2012 |
| WO | WO 2012/065181 A2 | 5/2012 |
| WO | WO 2012/066095 A1 | 5/2012 |
| WO | WO 2012/040459 A3 | 6/2012 |
| WO | WO 2012/076513 A1 | 6/2012 |
| WO | WO 2012/080389 A1 | 6/2012 |
| WO | WO 2012/083078 A2 | 6/2012 |
| WO | WO 2012/083181 A1 | 6/2012 |
| WO | WO-2012080376 A1 | 6/2012 |
| WO | WO 2012/121057 A1 | 9/2012 |
| WO | WO 2012/149563 A1 | 11/2012 |
| WO | WO 2012/174423 A1 | 12/2012 |
| WO | WO 2012/175962 A1 | 12/2012 |
| WO | WO 2013/033645 A1 | 3/2013 |
| WO | WO 2013/036208 A1 | 3/2013 |
| WO | WO 2013/049250 A1 | 4/2013 |

OTHER PUBLICATIONS

U.S. Appl. No. 14/070,354, filed Nov. 1, 2013, Walensky et al.
U.S. Appl. No. 14/070,367, filed Nov. 1, 2013, Nash.
U.S. Appl. No. 14/156,350, filed Jan. 15, 2014, Nash et al.
U.S. Appl. No. 61/385,405, filed Sep. 22, 2010, Verdine et al.
[No Author Listed] Designing Custom Peptide. from SIGMA Genosys, pp. 1-2. Accessed Jul. 27, 2012.

Adhikary, et al. Transcriptional regulation and transformation by Myc proteins. Nat Rev Mol Cell Biol. Aug. 2005;6(8):635-45.
Agola et al., Rab GTPases as regulators of endocytosis, targets of disease and therapeutic opportunities. Clin Genet. Oct. 2011; 80(4): 305-318.
Altschul et al., Basic local alignment search tool. J Mol Biol. Oct. 5, 1990;215(3):403-10.
Aman, et al. cDNA cloning and characterization of the human interleukin 13 receptor alpha chain. J Biol Chem. Nov. 15, 1996;271(46):29265-70.
Andrews et al. Fomiing Stable Helical Peptide Using Natural and Artificial Amino Acids. Tetrahedron. 1999;55:11711-11743.
Andrews, et al. Forming Stable Helical Peptides Using Natural and Artificial Amino Acids. Tetrahedron 55:11711-11743 (1999).
Andrews, et al. Kinetic analysis of the interleukin-13 receptor complex. J Biol Chem. Nov. 29, 2002;277(48):46073-8.
Annis, et al. A general technique to rank protein-ligand binding affinities and determine allosteric versus direct binding site competition in compound mixtures. J Am Chem Soc. Dec. 1, 2004;126(47):15495-503.
Annis, et al. ALIS: An Affinity Selection-Mass Spectrometry System for the Discovery and Characterization of Protein-Ligand Interactions. In: Wanner, K. and Höfner, G. eds. Mass Spectrometry in Medicinal Chemistry. Wiley-VCH; 2007:121-156.
Armstrong, et al. X=Y-ZH Systems as potential 1,3-dipoles. 5. Intramolecular cycloadditions of imines of a-amino acid esters. Tetrahedron. 1985;41(17):3547-58.
Attisano, et al. TGFbeta and Wnt pathway cross-talk. Cancer Metastasis Rev. Jan.-Jun. 2004;23(1-2):53-61.
Austin et al., "A Template for Stabilization of a Peptide α-Helix: Synthesis and Evaluation of Conformational Effects by Circular Dichroism and NMR," J. Am. Chem. Soc. 119:6461-6472 (1997).
Babine, et al. Molecular Recognition of Proteinminus signLigand Complexes: Applications to Drug Design. Chem Rev. Aug. 5, 1997;97(5):1359-1472.
Baek, et al. Structure of the stapled p53 peptide bound to Mdm2. J Am Chem Soc. Jan. 11, 2012;134(1):103-6. doi: 10.1021/ja2090367. Epub Dec. 14, 2011.
Baell, J.B. Prospects for Targeting the Bcl-2 Family of Proteins to Develop Novel cytotoxic drugs. Biochem Pharmacol. Sep. 2002;64(5-6):851-63.
Bakhshi, et al. Cloning the chromosomal breakpoint of t(14;18) human lymphomas: clustering around JH on chromosome 14 and near a transcriptional unit on 18. Cell. Jul. 1985;41(3):899-906.
Banerjee, et al. Structure of a DNA glycosylase searching for lesions. Science. Feb. 24, 2006;311(5764):1153-7.
Banerjee, et al. Structure of a repair enzyme interrogating undamaged DNA elucidates recognition of damaged DNA. Nature. Mar. 31, 2005;434(7033):612-8.
Banerji et al., "Synthesis of Cyclic β-Turn Mimics from L-Pro-Phe/Phe-L-Pro Derived Di- and Tripeptides via Ring Closing Metathesis: The Role of Chirality of the Phe Residue During Cyclization," Tetrahedron Lett. 43:6473-6477 (2002).
Bang, et al. Total chemical synthesis of crambin. J Am Chem Soc. Feb. 11, 2004;126(5):1377-83.
Bang, et al. Total chemical synthesis of crambin. J Am Chem Soc. 2004; 126(5):1377-83.
Barandon, et al. Reduction of infarct size and prevention of cardiac rupture in transgenic mice overexpressing FrzA. Circulation. Nov. 4, 2003;108(18):2282-9. Epub Oct. 27, 2003.
Barker, et al. Mining the Wnt pathway for cancer therapeutics. Nat Rev Drug Discov. Dec. 2006;5(12):997-1014.
Beloken, et al. Chiral Complexes of Ni(II), Cu(II) and Cu(I) as Reagents, Catalysts and Receptors for Asymmetric Synthesis and Chiral Recognition of Amino Acids. Pure & Appl Chem. 1992;64(12):1917-24.
Belokon, et al. Improved procedures for the synthesis of (S)-2-[N-(N'-benzyl-prolyl)amino]benzophenone (BPB) and Ni(II) complexes of Schiffs bases derived from BPB and amino acids. Tetrahedron: Asymmetry. 1998; 9:4249-52.
Bennett, et al. Regulation of osteoblastogenesis and bone mass by Wntl Ob. Proc Natl Acad Sci U S A. Mar. 1, 2005;102(9):3324-9.. Epub Feb. 22, 2005.

(56) References Cited

OTHER PUBLICATIONS

Berendsen et al., A glimpse of the Holy Grail? Science. Oct. 23, 1998;282(5389):642-3.
Berge, et al. Pharmaceutical salts. J Pharm Sci. Jan. 1977;66(1):1-19.
Bernal, et al. A stapled p53 helix overcomes HDMX-mediated suppression of p53. Cancer Cell. Nov. 16, 2010;18(5):411-22. doi: 10.1016/j.ccr.2010.10.024.
Bernal, et al. Reactivation of the p53 tumor suppressor pathway by a stapled p53 peptide. J Am Chem Soc. Mar. 7, 2007;129(9):2456-7.
Biagini, et al. Cross-metathesis of Unsaturated a-amino Acid Derivatives. J Chem Soc Perkin Trans. 1998;1:2485-99.
Bierzynski, et al. A salt bridge stabilizes the helix formed by isolated C-peptide of RNase A. Proc Natl Acad Sci U S A. Apr. 1982;79(8):2470-4.
Blackwell, et al. Highly efficient synthesis of covalently cross-linked peptide helices by ring-closing metathesis. Angew Chem Int Ed. 1994; 37(23):3281-84.
Blackwell, et al. Ring-closing metathesis of olefinic peptides: design, synthesis, and structural characterization of macrocyclic helical peptides. J Org Chem. Aug. 10, 2001;66(16):5291-302.
Blundell et al., Atomic positions in rhombohedral 2-zinc insulin crystals. Nature. Jun. 25, 1971;231(5304):506-11.
Bode, et al. Chemoselective amide ligations by decarboxylative condensations of N-alkylhydroxylamines and alpha-ketoacids. Angew Chem Int Ed Engl. Feb. 13, 2006;45(8):1248-52.
Boguslavsky, et al. Effect of peptide conformation on membrane permeability. J Pept Res. Jun. 2003;61(6):287-97.
Bossy-Wetzel, et al. Assays for cytochrome c release from mitochondria during apoptosis. Methods Enzymol. 2000;322:235-42.
Bossy-Wetzel, et al. Detection of apoptosis by annexin V labeling. Methods Enzymol. 2000;322:15-8.
Bottger, et al. Molecular characterization of the hdm2-p53 interaction. J Mol Biol. Jun. 27, 1997;269(5):744-56.
Boyden, et al. High bone density due to a mutation in LDL-receptor-related protein 5. N Engl J Med. May 16, 2002;346(20):1513-21.
Bracken, et al. Synthesis and nuclear magnetic resonance structure determination of an alpha-helical, bucyclic, lactam-bridged hexpeptide. J Am Chem Soc. 1994; 116:6431-32.
Bradley et al., Limits of cooperativity in a structurally modular protein: response of the Notch ankyrin domain to analogous alanine substitutions in each repeat. J Mol Biol. Nov. 22, 2002;324(2):373-86.
Brandt et al., Dimeric fragment of the insulin receptor alpha-subunit binds insulin with full holoreceptor affinity. J Biol Chem. Apr. 13, 2001;276(15):12378-84. Epub Jan. 12, 2001.
Brown, et al. A spiroligomer α-helix mimic that binds HDM2, penetrates human cells and stabilizes HDM2 in cell culture. PLoS One. 2012;7(10):e45948. doi: 10.1371/journal.pone.0045948. Epub Oct. 18, 2012.
Brown, et al. Stapled peptides with improved potency and specificity that activate p53. ACS Chem Biol. Mar. 15, 2013;8(3):506-12. doi: 10.1021/cb3005148. Epub Dec. 18, 2012.
Brubaker, et al. Solution structure of the interacting domains of the Mad-Sin3 complex: implications for recruitment of a chromatin-modifying complex. Cell. Nov. 10, 2000;103(4):655-65.
Brunel, et al. Synthesis of constrained helical peptides by thioether ligation: application to analogs of gp41. Chem Commun (Camb). May 28, 2005;(20):2552-4. Epub Mar. 11, 2005.
Brusselle, et al. Allergen-induced airway inflammation and bronchial responsiveness in wild-type and interleukin-4-deficient mice. Am J Respir Cell Mol Biol. Mar. 1995;12(3):254-9.
Burger, et al. Synthesis of a-(trifluoromethyl)-substituted a-amino acids. Part 7. An efficient synthesis for a-trifluoromethyl-substituted w-carboxy a-amino acids. Chemiker-Zeitung. 1990;114(3):101-04. German.
Cabezas & Satterthwait, "The Hydrogen Bond Mimic Approach: Solid-phase Synthesis of a Peptide Stabilized as an α-Helix with a Hydrazone Link," J. Am. Chem. Soc. 121:3862-3875 (1999).
Caricasole, et al. The Wnt pathway, cell-cycle activation and beta-amyloid: novel therapeutic strategies in Alzheimer's disease? Trends Pharmacol Sci. May 2003;24(5):233-8.
Carillo et al., The Multiple Sequence Alignment Problem in Biology. SIAM J Applied Math. 1988;48:1073-82.
Carlson et al., Specificity landscapes of DNA binding molecules elucidate biological function. Proc Natl Acad Sci USA. Mar. 9, 2010;107(10):4544-9. doi: 10.1073/pnas.0914023107. Epub Feb. 22, 2010.
Chakrabartty et al., "Helix Capping Propensities in Peptides Parallel Those in Proteins," Proc. Nat'l Acad. Sci. USA 90:11332-11336 (1993).
Chang, et al. Stapled α-helical peptide drug development: a potent dual inhibitor of MDM2 and MDMX for p53-dependent cancer therapy. Proc Natl Acad Sci U S A. Sep. 3, 2013;110(36):E3445-54. doi: 10.1073/pnas.1303002110. Epub Aug. 14, 2013.
Chapman et al., "A Highly Stable Short α-Helix Constrained by a Main-chain Hydrogen-bond Surrogate," J. Am. Chem. Soc. 126:12252-12253 (2004).
Chapman, et al. Optimized synthesis of hydrogen-bond surrogate helices: surprising effects of microwave heating on the activity of Grubbs catalysts. Org Lett. Dec. 7, 2006;8(25):5825-8.
Chen et al., Determination of the helix and beta form of proteins in aqueous solution by circular dichroism. Biochemistry. Jul. 30, 1974;13(16):3350-9.
Chen, et al. Small molecule-mediated disruption of Wnt-dependent signaling in tissue regeneration and cancer.. Nat Chem Biol. Feb. 2009;5(2):100-7. Epub Jan. 4, 2009.
Cheng et al., Emerging role of RAB GTPases in cancer and human disease. Cancer Res. Apr. 1, 2005;65(7):2516-9.
Cheng et al., The RAB25 small GTPase determines aggressiveness of ovarian and breast cancers. Nat Med. Nov. 2004;10(11):1251-6. Epub Oct. 24, 2004.
Cheon, et al. beta-Catenin stabilization dysregulates mesenchymal cell proliferation, motility, and invasiveness and causes aggressive fibromatosis and hyperplastic cutaneous wounds. Proc Natl Acad Sci U S A. May 14, 2002;99(10):6973-8. Epub Apr. 30, 2002.
Chia et al., Emerging roles for Rab family GTPases in human cancer. Biochim Biophys Acta. Apr. 2009;1795(2):110-6.
Chiaramonte, et al. Studies of murine schistosomiasis reveal interleukin-13 blockade as a treatment for established and progressive liver fibrosis. Hepatology. Aug. 2001;34(2):273-82.
Chin & Schepartz, "Design and Evolution of a Miniature Bcl-2 Binding Protein," Angew. Chem. Int. Ed. 40(20):3806-3809 (2001).
Chin et al., "Circular Dichroism Spectra of Short, Fixed-nucleus Alanine Helices," Proc. Nat'l Acad. Sci. USA 99(24):15416-15421 (2002).
Chittenden, et al. A conserved domain in Bak, distinct from BH1 and BH2, mediates cell death and protein binding functions. Embo J. Nov. 15, 1995;14(22):558-996.
Christodoulides, et al. WNT10B mutations in human obesity. Diabetologia. Apr. 2006;49(4):678-84. Epub Feb. 14, 2006.
Clark, et al. Supramolecular Design by Covalent Capture. Design of a Peptide Cylinder via Hydrogen-Bond-Promoted Intermolecular Olefin Metathesis. J Am Chem Soc. 1995;117:12364-65.
Cleary, et al. Nucleotide sequence of a t(14;18) chromosomal breakpoint in follicular lymphoma and demonstration of a breakpoint-cluster region near a transcriptionally active locus on chromosome 18. Proc Natl Acad Sci U S A. Nov. 1985;82(21):7439-43.
Clevers. Wnt/beta-catenin signaling in development and disease. Cell. Nov. 3, 2006;127(3):469-80.
Cohn, et al. IL-4-independent induction of airway hyperresponsiveness by Th2, but not Th1, cells. J Immunol. Oct. 15, 1998;161(8):3813-6.
Cole, et al. Transcription-independent functions of MYC: regulation of translation and DNA replication. Nat Rev Mol Cell Biol. Oct. 2008;9(10):810-5.
Cong, et al. A protein knockdown strategy to study the function of beta-catenin in tumorigenesis. BMC Mol Biol. Sep. 29, 2003;4:10.
Cossu, et al. Wnt signaling and the activation of myogenesis in mammals. EMBO J. Dec. 15, 1999;18(24):6867-72.
Cusack, et al. 2,4,6-Tri-isopropylbenzenesulphonyl Hydrazide: A Convenient Source of Di-imide. Tetrahedron. 1976;32:2157-62.

(56) References Cited

OTHER PUBLICATIONS

Danial, et al. Cell death: critical control points. Cell. 2004; 116:204-219.
David, et al. Expressed protein ligation. Method and applications. Eur J Biochem. Feb. 2004;271(4):663-77.
Dawson, et al. Synthesis of proteins by native chemical ligation. Science. Nov. 4, 1994;266(5186):776-9.
De Guzman, et al. Structural basis for cooperative transcription factor binding to the CBP coactivator. J Mol Biol. Feb. 3, 2006;355(5):1005-13.
De Meyts et al., Insulin interactions with its receptors: experimental evidence for negative cooperativity. Biochem Biophys Res Commun. Nov. 1, 1973;55(1):154-61.
De Meyts, The structural basis of insulin and insulin-like growth factor-I receptor binding and negative co-operativity, and its relevance to mitogenic versus metabolic signalling. Diabetologia. Sep. 1994;37 Suppl 2:S135-48.
Debinski, et al. Retargeting interleukin 13 for radioimmunodetection and radioimmunotherapy of human high-grade gliomas. Clin Cancer Res. Oct. 1999;5(10 Suppl):3143s-3147s.
Degterev et al., "Identification of Small-molecule Inhibitors of Interaction between the BH3 Domain and BCL-xL," Nature Cell Biol. 3:173-182 (2001).
Deiters, et al. Adding amino acids with novel reactivity to the genetic code of Saccharomyces cerevisiae. J. Am. Chem. Soc. Oct. 1, 2003;125(39):11782-11783.
Denmark, et al. Cyclopropanation with Diazomethane and Bis(oxazoline)palladium(II) Complexes. J Org Chem. May 16, 1997;62(10):3375-3389.
Designing Custom Peptide. from SIGMA Genosys, pp. 1-2. Accessed Dec. 16, 2004.
Devereux et al., A comprehensive set of sequence analysis programs for the VAX. Nucleic Acids Res. Jan. 11, 1984;12(1 Pt 1):387-95.
Dimartino, et al. Solid-phase synthesis of hydrogen-bond surrogate-derived alpha-helices. Org Lett. Jun. 9, 2005;7(12):2389-92.
Doron, et al. Probiotics: their role in the treatment and prevention of disease. Expert Rev Anti Infect Ther. Apr. 2006;4(2):261-75.
Eisenmesser, et al. Solution structure of interleukin-13 and insights into receptor engagement. J Mol Biol. Jun. 29, 2001;310(1):231-41.
Ellis, et al. Design, synthesis, and evaluation of a new generation of modular nucleophilic glycine equivalents for the efficient synthesis of sterically constrained alpha-amino acids. J Org Chem. Oct. 27, 2006;71(22):8572-8.
Erlanson, et al. The leucine zipper domain controls the orientation of AP-1 in the NFAT.AP-1.DNA complex. Chem Biol. Dec. 1996;3(12):981-91.
European office action dated Aug. 20, 2012 for EP Application No. 09730445.5.
European search report and opinion dated Jul. 20, 2012 for EP Application No. 12159110.1.
European search report and opinion dated Sep. 27, 2012 for EP Application No. 12159110.1.
European search report and search opinion dated May 6, 2011 for Application No. 10195495.6.
European search report and search opinion dated May 9, 2011 for Application No. 10195490.7.
European search report dated Oct. 16, 2013 for EP Application No. 10800148.8.
European search report dated Nov. 7, 2008 for Application No. 8016651.5.
European search report dated Dec. 6, 2012 for EP Application No. 09800675.2.
European search report dated Aug. 22, 2008 for Application No. 4811198.3.
Evans et al., The Rise of Azide—Alkyne 1,3-Dipolar 'Click' Cycloaddition and its Application to Polymer Science and Surface Modification. Australian Journal of Chemistry. 2007;60:384-95.
Favrin, et al. Two-state folding over a weak free-energy barrier. Biophys J. Sep. 2003;85(3):1457-65.
Felix et al., "Synthesis, Biological Activity and Conformational Analysis of Cyclic GRF Analogs," Int. J. Pep. Protein Res. 32:441-454 (1988).
Fields, et al. Chapter 3 in Synthetic Peptides: A User's Guide. Grant W.H. Freeman & Co. New York, NY. 1992. p. 77.
Fieser, et al. Fieser and Fieser's Reagents for Organic Synthesis. John Wiley and Sons. 1994.
Fischback, et al. Specific biochemical inactivation of oncogenic Ras proteins by nucleoside diphosphate kinase. Cancer Res. Jul. 15, 2003;63(14):4089-94.
Fischer, et al. Apoptosis-based therapies and drug targets. Cell Death and Differentiation. 2005; 12:942-961.
Fischer, et al. The HIV-1 Rev activation domain is a nuclear export signal that accesses an export pathway used by specific cellular RNAs. Cell. Aug. 11, 1995;82(3):475-83.
Fisher et al., Myc/Max and other helix-loop-helix/leucine zipper proteins bend DNA toward the minor groove. Proc Natl Acad Sci U S A. Dec. 15, 1992;89(24):11779-83.
Formaggio, et al. Inversion of 3(10)-helix screw sense in a (D-alpha Me)Leu homo-tetrapeptide induced by a guest D-(alpha Me)Val residue. J Pept Sci. Nov.-Dec. 1995;1(6):396-402.
Fromme, et al. Structural basis for removal of adenine mispaired with 8-oxoguanine by MutY adenine DNA glycosylase. Nature. Feb. 12, 2004;427(6975):652-6.
Fuchs, et al. Socializing with the neighbors: stem cells and their niche. Cell. Mar. 19, 2004;116(6):769-78.
Fulda, et al. Extrinsic versus intrinsic apoptosis pathways in anti-cancer chemotherapy. Oncogene. Aug. 7, 2006;25(34):4798-811.
Furstner, et al. Alkyne metathesis: development of a novel molybdenum-based catalyst system and its application to the total synthesis of epothilone A and C. Chemistry. Dec. 17, 2001;7(24):5299-317.
Furstner, et al. Mo[N(t-Bu)(AR)]3 Complexes as catalyst precursors: In situ activation and application to metathesis reactions of alkynes and diynes. J Am chem Soc. 1999; 121:9453-54.
Furstner, et al. Nozaki—Hiyama—Kishi reactions catalytic in chromium. J Am Chem Soc. 1996; 118:12349-57.
Galande, et al. An effective method of on-resin disulfide bond formation in peptides. J. Comb. Chem. Mar.-Apr. 2005;7(2):174-177.
Gallivan, et al. A neutral, water-soluble olefin metathesis catalyst based on an N-heterocyclic carbene ligand. Tetrahedron Letters. 2005; 46:2577-80.
Galluzzi, et al. Guidelines for the use and interpretation of assays for monitoring cell death in higher eukaryotes. Cell Death Differ. Aug. 2009;16(8):1093-107. Epub Apr. 17, 2009.
Gante. Peptidomimetics—Tailored enzyme inhibitors. J Angew Chem Int Ed Engl. 1994; 33:1699-1720.
Gat, et al. De Novo hair follicle morphogenesis and hair tumors in mice expressing a truncated beta-catenin in skin. Cell. Nov. 25, 1998;95(5):605-14.
Gavathiotis, et al. BAX activation is initiated at a novel interaction site. Nature. Oct. 23, 2008;455(7216):1076-81.
Gerber-Lemaire, et al. Glycosylation pathways as drug targets for cancer: glycosidase inhibitors. Mini Rev Med Chem. Sep. 2006;6(9):1043-52.
Ghadiri & Choi, "Secondary Structure Nucleation in Peptides. Transition Metal Ion Stabilized α-Helices," J. Am. Chem. Soc. 112:1630-1632 (1990).
Giannis, et al. Peptidomimetics for receptor ligands—Discovery, development, and medical perspectives. Angew Chem Int Ed Engl. 1993; 32:1244-67.
Gong, et al. LDL receptor-related protein 5 (LRP5) affects bone accrual and eye development. Cell. Nov. 16, 2001;107(4):513-23.
Goodson, et al. Potential Growth Antagonists. I. Hydantoins and Disubstituted Glycines. J Org Chem. 1960;25:1920-24.
Gorlich, et al. Transport between the cell nucleus and the cytoplasm. Annu Rev Cell Dev Biol. 1999; 15:607-60.
Goun, et al. Molecular transporters: synthesis of oligoguanidinium transporters and their application to drug delivery and real-time imaging. Chembiochem. Oct. 2006;7(10):1497-515.
Greene, et al. Protective Groups in Organic Synthesis, 2nd Ed. John Wiley and Sons. 1991.

(56) References Cited

OTHER PUBLICATIONS

Greenfield, et al. Computed circular dichroism spectra for the evaluation of protein conformation. Biochemistry. Oct. 1969;8(10):4108-16.
Greenlee et al., A General Synthesis of a-vinyl-a-amino acids. Tetrahedron Letters. 1978;42:3999-4002.
Grossman, et al Inhibition of oncogenic Wnt signaling through direct targeting of—catenin. Proc. Natl. Acad. Sco. 2012; 109(44):17942-179747.
Grubbs, et al. Ring-closing metathesis and related processes in organic synthesis. Acc Chem Res. 1995; 28(11):446-52.
Grunig, et al.Requirement for IL-13 independently of IL-4 in experimental asthma. Science. Dec. 18, 1998;282(5397):2261-3.
Guinn, et al. Synthesis and characterization of polyamides containing unnatural amino acids. Biopolymers. May 1995;35(5):503-12.
Harper, et al.Efficacy of a bivalent L1 virus-like particle vaccine in prevention of infection with human papillomavirus types 16 and 18 in young women: a randomised controlled trial. Lancet. Nov. 13-19, 2004;364(9447):1757-65.
Harris et al., Synthesis of proline-modified analogues of the neuroprotective agent glycyl-lprolyl-glutamic acid (GPE). Tetrahedron. 2005;61:10018-35.
Hartmann, et al. Dual roles of Wnt signaling during chondrogenesis in the chicken limb. Development. Jul. 2000;127(14):3141-59.
Hartmann. A Wnt canon orchestrating osteoblastogenesis. Trends Cell Biol. Mar. 2006;16(3):151-8. Epub Feb. 7, 2006.
Hellman et al., Electrophoretic mobility shift assay (EMSA) for detecting protein-nucleic acid interactions. Nat Protoc. 2007;2(8):1849-61.
Henchey, et al. Contemporary strategies for the stabilization of peptides in the a-helical conformation. Curr Opin Chem Biol. 2008;12:692-97.
Hipfner, et al. Connecting proliferation and apoptosis in development and disease. Nat Rev Mol Cell Biol. Oct. 2004;5(10):805-15.
Hiroshige, et al. Palladium-mediated macrocyclisations on solid support and its applica-tions to combinatorial synthesis. J. Am. Chem. Soc. 1995; 117:11590-11591.
Hoang, et al. Dickkopf 3 inhibits invasion and motility of Saos-2 osteosarcoma cells by modulating the Wnt-beta-catenin pathway. Cancer Res. Apr. 15, 2004;64(8):2734-9.
Holford, et al. Adding 'splice' to protein engineering. Structure. Aug. 15, 1998;6(8):951-6.
Hoveyda et al., "Ru Complexes Bearing Bidentate Carbenes: From Innocent Curiosity to Uniquely Effective Catalysts for Olefin Metathesis," Org. Biomolec. Chem. 2:8-23 (2004).
Hu, et al. Efficient p53 activation and apoptosis by simultaneous disruption of binding to MDM2 and MDMX. Cancer Res. Sep. 15, 2007;67(18):8810-7.
Huang et al., How insulin binds: the B-chain alpha-helix contacts the L1 beta-helix of the insulin receptor. J Mol Biol. Aug. 6, 2004;341(2):529-50.
Huang, et al. Tankyrase inhibition stabilizes axin and antagonizes Wnt signalling. Nature. Oct. 1, 2009;461(7264):614-20. Epub Sep. 16, 2009.
International preliminary report on patentability dated Jan. 3, 2014 for PCT/US2012/042738.
International preliminary report on patentability dated Feb. 3, 2011 for PCT/US2009/004260.
International preliminary report on patentability dated Apr. 4, 2013 for PCT/US2011/052755.
International preliminary report on patentability dated Oct. 8, 2009 for PCT/US2008/058575.
International Preliminary Report on Patentability for PCT/US2010/001952, Jan. 26, 2012.
International search report and written opinion dated Nov. 17, 2008 for PCT/US2008/058575.
International search report and written opinion dated Jan. 30, 2014 for PCT/US2013/062929.
International search report and written opinion dated Feb. 2, 2011 for PCT/US2010/001952.
International search report and written opinion dated May 16, 2008 for PCT/US2008/052580.
International search report and written opinion dated Oct. 12, 2011 for PCT/US2011/047692.
International search report and written opinion dated Oct. 15, 2010 for PCT/US2009/004260.
International Search Report and Written Opinion for PCT/US2011/052755, mailed Apr. 25, 2012.
International Search Report and Written Opinion for PCT/US2012/042738, mailed Oct. 18, 2012.
International search report and written report dated May 23, 2013 for PCT/US2013/026241.
International search report and written report dated May 29, 2013 for PCT/US2013/026238.
International search report dated Nov. 30, 2009 for PCT Application No. US2009/02225.
International search report dated May 18, 2005 for PCT Application No. US2004/38403.
Invitation to pay additional fees dated Jan. 2, 2014 for PCT/US2013/062004.
Invitation to pay additional fees dated Mar. 19, 2010 for PCT/US2010/004260.
Invitation to pay additional fees dated Oct. 29, 2010 for PCT/US2010/001952.
Invitation to Pay Additional Fees for PCT/US2011/052755 mailed Feb. 16, 2012.
Jackson, et al. General Approach to the Synthesis of Short a-Helical Peptides. J Am Chem Soc. 1991;113:9391-93.
Jamieson, et al. Granulocyte-macrophage progenitors as candidate leukemic stem cells in blast-crisis CML. N Engl J Med. Aug. 12, 2004;351(7):657-67.
Jensen et al., Activation of the insulin receptor (IR) by insulin and a synthetic peptide has different effects on gene expression in IR-transfected L6 myoblasts. Biochem J. Jun. 15, 2008;412(3):435-45. doi: 10.1042/BJ20080279.
Ji, et al. In vivo activation of the p53 tumor suppressor pathway by an engineered cyclotide. J Am Chem Soc. Aug. 7, 2013;135(31):11623-33. doi: 10.1021/ja405108p. Epub Jul. 25, 2013.
Jordan, et al. Wnt4 overexpression disrupts normal testicular vasculature and inhibits testosterone synthesis by repressing steroidogenic factor 1/beta-catenin synergy. Proc Natl Acad Sci U S A. Sep. 16, 2003;100(19):10866-71. Epub Aug. 29, 2003.
Junutula et al., Molecular characterization of Rabll interactions with members of the family of Rabl 1-interacting proteins. J Biol Chem. Aug. 6, 2004;279(32):33430-7. Epub Jun. 1, 2004.
Kallen, et al. Crystal structures of human MdmX(HdmX) in complex with p53 peptide analogues reveal surprising conformational changes. Journal of Biological Chemistry. Mar. 27, 2009; 284:8812-8821.
Karle, et al. Structural charateristics of alpha-helical peptide molecules containing Aib residues. Biochemistry. Jul. 24, 1990;29(29):6747-56.
Karle. Flexibility in peptide molecules and restraints imposed by hydrogen bonds, the Aib residue, and core inserts. Biopolymers. 1996;40(1):157-80.
Karwoski, et al. Lysinonorleucine cross-link formation in alpha amino heptenoic acid-substituted peptide derivatives. Biopolymers. 1978;17(5):1119-27.
Katoh, et al. Cross-talk of WNT and FGF signaling pathways at GSK3beta to regulate beta-catenin and SNAIL signaling cascades. Cancer Biol Ther. Sep. 2006;5(9):1059-64. Epub Sep. 4, 2006.
Katsu, et al. The human frizzled-3 (FZD3) gene on chromosome 8p21, a receptor gene for Wnt ligands, is associated with the susceptibility to schizophrenia. Neurosci Lett. Dec. 15, 2003;353(1):53-6.
Kaul, et al. Stereochemical control of peptide folding. Bioorg Med Chem. Jan. 1999;7(1):105-17.
Kawamoto, Targeting the BCL9/B9L binding interaction with beta-catenin as a potential anticancer strategy. PhD Thesis. Jun. 3, 2010. Available at http://deepblue.lib.umich.edu/handle/2027.42/758461ast accessed Apr. 9, 2012. Abstract only. 2 pages.

(56) References Cited

OTHER PUBLICATIONS

Kazmaier, Sythesis of Quaternary Amino Acids Containing 3, y- as well as 7,6-Unsaturated Side Chains via Chelate-Enolate Claisen Rearrangement. Tetrahedron Letters. 1996;37(30):5351-4.

Kelly-Welch, et al. Interleukin-4 and interleukin-13 signaling connections maps. Science. Jun. 6, 2003;300(5625):1527-8.

Kelso et al., "A Cyclic Metallopeptide Induces a Helicity in Short Peptide Fragments of Thermolysin," Angew. Chem. Int. Ed. 42(4):421-424 (2003).

Kelso et al., "α-Turn Mimetics: Short Peptide α-Helices Composed of Cyclic Metallopentapeptide Modules," J. Am. Chem. Soc. 126:4828-4842 (2004).

Kemp et al., "Studies of N-Terminal Templates for α-Helix Formation. Synthesis and Conformational Analysis of (2S,5S,8S,11S)-1-Acetyl-1,4-diaza-3-keto-5-carboxy-10-thiatricyclo[2.8.1.04,8]-tridecane (Ac-Hell-OH)," J. Org. Chem. 56:6672-6682 (1991).

Kent. Advanced Biology. Oxford University Press. 2000.

Khalil, et al. An efficient and high yield method for the N-tert-butoxycarbonyl protection of sterically hindered amino acids. Tetrahedron Lett. 1996; 37(20):3441-44.

Kilby et al., "Potent Suppression of HIV-1 Replication in Humans by T-20, a Peptide Inhibitor of gp41-Mediated Virus Entry," Nat. Med. 4(11):1302-1307 (1998).

Kim et al., Synthesis of all-hydrocarbon stapled a-helical peptides by ring-closing olefin metathesis. Nat Protoc. Jun. 2011;6(6):761-71. doi: 10.1038/nprot.2011.324. Epub May 12, 2011.

Kim, et al. Stereochemical effects of all-hydrocarbon tethers in i,i+4 stapled peptides. Bioorg Med Chem Lett. May 1, 2009;19(9):2533-6.

Kimmerlin, et al. '100 years of peptide synthesis': ligation methods for peptide and protein synthesis with applications to beta-peptide assemblies. J Pept Res. Feb. 2005;65(2):229-60.

Kinzler, et al. Identification of FAP locus genes from chromosome 5q21. Science. Aug. 9, 1991;253(5020):661-5.

Kinzler, et al. Lessons from hereditary colorectal cancer. Cell. Oct. 18, 1996;87(2):159-70.

Knackmuss, et al. Specific inhibition of interleukin-13 activity by a recombinant human single-chain immunoglobulin domain directed against the IL-13 receptor alpha1 chain. Biol Chem. Mar. 2007;388(3):325-30.

Kohler et al., DNA specificity enhanced by sequential binding of protein monomers. Proc Natl Acad Sci U S A. Oct. 12, 1999;96(21):11735-9.

Kolb et al., Click Chemistry: Diverse Chemical Function from a Few Good Reactions. Angew Chem Int Ed Engl. Jun. 1, 2001;40(11):2004-2021.

Kondo, et al. Frizzled 4 gene (FZD4) mutations in patients with familial exudative vitreoretinopathy with variable expressivity. Br J Ophthalmol. Oct. 2003;87(10):1291-5.

Korcsmaros, et al. Uniformly curated signaling pathways reveal tissue-specific cross-talks and support drug target discovery. Bioinformatics. Aug. 15, 2010;26(16):2042-50. Epub Jun. 11, 2010.

Korinek, et al. Depletion of epithelial stem-cell compartments in the small intestine of mice lacking Tcf-4. Nat Genet. Aug. 1998;19(4):379-83.

Kotha, et al. Modification of constrained peptides by ring-closing metathesis reaction. Bioorg Med Chem Lett. Jun. 4, 2001;11(11):1421-3.

Kouzarides, et al. Acetylation: a regulatory modification to rival phosphorylation? EMBO J. Mar. 15, 2000;19(6):1176-9.

Kozlovsky, et al. GSK-3 and the neurodevelopmental hypothesis of schizophrenia. Eur Neuropsychopharmacol. Feb. 2002;12(1):13-25.

Kristensen et al., Expression and characterization of a 70-kDa fragment of the insulin receptor that binds insulin Minimizing ligand binding domain of the insulin receptor. J Biol Chem. Jul. 10, 1998;273(28):17780-6.

Kristensen et al., Functional reconstitution of insulin receptor binding site from non-binding receptor fragments. J Biol Chem. May 24, 2002;277(21):18340-5. Epub Mar. 18, 2002.

Kritzer et al., "Helical β-Peptide Inhibitors of the p53-hDM2 Interaction," J. Am. Chem. Soc. 126:9468-9469 (2004).

Kurose et al., Cross-linking of a B25 azidophenylalanine insulin derivative to the carboxyl-terminal region of the alpha-subunit of the insulin receptor. Identification of a new insulin-binding domain in the insulin receptor. J Biol Chem. Nov. 18, 1994;269(46):29190-7.

Kussie, et al. Structure of the MDM2 oncoprotein bound to the p53 tumor suppressor transactivation domain. Science. Nov. 8, 1996;274(5289):948-53.

Kutchukian, et al. All-atom model for stabilization of alpha-helical structure in peptides by hydrocarbon staples. J Am Chem Soc. Apr. 8, 2009;131(13):4622-7.

Kutzki et al., "Development of a Potent Bcl-xL Antagonist Based on α-Helix Mimicry," J. Am. Chem. Soc. 124:11838-11839 (2002).

Kwon, et al. Quantitative comparison of the relative cell permeability of cyclic and linear peptides. Chem Biol. Jun. 2007;14(6):671-7.

Lacombe, et al. Reduction of Olefms on Solid Support Using Diimide Tetranderon Lett. 1998;39:6785-86.

Lammi, et al. Mutations in AXIN2 cause familial tooth agenesis and predispose to colorectal cancer. Am J Hum Genet. May 2004;74(5):1043-50. Epub Mar. 23, 2004.

Laporte, et al. Molecular and structural basis of cytokine receptor pleiotropy in the interleukin-4/13 system. Cell. Jan. 25, 2008;132(2):259-72.

Larock. Comprehensive Organic Transformations. VCH Publishers. 1989.

Le Geuzennec, et al. Molecular characterization of Sin3 PAH-domain interactor specificity and identification of PAH partners. Nucleic Acids Res. 2006;34(14):3929-37. Epub Aug. 12, 2006.

Le Geuzennec, et al. Molecular determinants of the interaction of Mad with the PAH2 domain of mSin3. J Biol Chem. Jun. 11, 2004;279(24):25823-9.

Leduc, et al. Helix-stabilized cyclic peptides as selective inhibitors of steroid receptor-coactivator interactions. Proc Natl Acad Sci U S A. Sep. 30, 2003;100(20):11273-8.

Lee, et al. A novel BH3 ligand that selectively targets Mcl-1 reveals that apoptosis can proceed without Mcl-1 degradation. J Cell Biol. Jan. 28, 2008;180(2):341-355.

Li, et al. A convenient preparation of 5-iodo-1,4-disubstituted-1,2,3-triazole: multicomponent one-pot reaction of azide and alkyne mediated by CuI-NBS. J Org Chem. May 2, 2008;73(9):3630-3. doi: 10.1021/jo800035v. Epub Mar. 22, 2008.

Li, et al. Systematic mutational analysis of peptide inhibition of the p53-MDM2/MDMX interactions. J Mol Biol. Apr. 30, 2010;398(2):200-13. doi: 10.1016/j.jmb.2010.03.005. Epub Mar. 10, 2010.

Liang, et al. Wnt5a inhibits B cell proliferation and functions as a tumor suppressor in hematopoietic tissue. Cancer Cell. Nov. 2003;4(5):349-60.

Liskamp, et al. Conformationally restricted amino acids and dipeptides, (non)peptidomimetics and secondary structure mimetics. Red Travl Chim Pays-Bas. 1994; 113:1-19.

Litowski & Hodges, "Designing Heterodimeric Two-stranded α-Helical Coiled-coils: Effects of Hydrophobicity and α-Helical Propensity on Protein Folding, Stability, and Specificity," J. Biol. Chem. 277(40):37272-37279 (2002).

Little, et al. A Mutation in the LDL Receptor-Related Protein 5 Gene Results in the Autosomal Dominant High-Bone-Mass Trait. Am J Hum Genet. 2002;70:11-19.

Liu, et al. Chemical ligation approach to form a peptide bond between unprotected peptide segments. Concept and model study. J Am Chem Soc. 1994; 116(10):4149-53.

Liu, et al. Targeted degradation of beta-catenin by chimeric F-box fusion proteins. Biochem Biophys Res Commun. Jan. 23, 2004;313(4):1023-9.

Lo, et al. Phosphorylation by the beta-catenin/MAPK complex promotes 14-3-3-mediated nuclear export of TCF/POP-1 in signal-responsive cells in C. elegans. Cell. Apr. 2, 2004.;117(1):95-106.

Logan, et al. The Wnt signaling pathway in development and disease. Annu Rev Cell Dev Biol. 2004;20:781-810.

(56) References Cited

OTHER PUBLICATIONS

Losey, et al.Crystal structure of Staphylococcus aureus tRNA adenosine deaminase TadA in complex with RNA. Nat Struct Mol Biol. Feb. 2006;13(2):153-9.
Lou et al., The first three domains of the insulin receptor differ structurally from the insulin-like growth factor 1 receptor in the regions governing ligand specificity. Proc Natl Acad Sci U S A. Aug. 15, 2006;103(33):12429-34. Epub Aug. 7, 2006.
Loughlin, et al. Functional variants within the secreted frizzled-related protein 3 gene are associated with hip osteoarthritis in females. Proc Natl Acad Sci U S A. Jun. 29, 2004;101(26):9757-62. Epub Jun. 21, 2004.
Lu, et al. Proteomimetic libraries: design, synthesis, and evaluation of p53-MDM2 interaction inhibitors. J Comb Chem. May-Jun. 2006;8(3):315-25.
Luo, et al. Mechanism of helix induction by trifluoroethanol: a framework for extrapolating the helix-forming properties of peptides from trifluoroethanol/water mixtures back to water. Biochemistry. Jul. 8, 1997;36(27):8413-21.
Luo, et al. Wnt signaling and hunian diseases: what are the therapeutic implications? Lab Invest. Feb. 2007;87(2):97-103. Epub Jan. 8, 2007.
Luscher et al., The basic region/helix-loop-helix/leucine zipper domain of Myc protooncoproteins: function and regulation. Oncogene. May 13, 1999;18(19):2955-66.
Luu, et al. Wnt/beta-catenin signaling pathway as a novel cancer drug target. Curr Cancer Drug Targets. Dec. 2004;4(8):653-71.
Lyu & Wemmer, "Capping Interactions in Isolated a Helices: Position-dependent Substitution Effects and Structure of a Serine-capped Peptide Helix," Biochemistry 32:421-425 (1993).
Lyu et al, "α-Helix Stabilization by Natural and Unnatural Amino Acids with Alkyl Side Chains," Proc. Nat'l Acad. Sci. USA 88:5317-5320 (1991).
MacMillan. Evolving strategies for protein synthesis converge on native chemical ligation. Angew Chem Int Ed Engl. Nov. 27, 2006;45(46):7668-72.
Mai et al. A proapoptotic peptide for the treatment of solid tumors Cancer Res. Nov. 1, 2001;61(21):7709-12.
Mannhold, R., Kubinyi, H., Folkers, G., series eds. Molecular Drug Properties: Measurement and Prediction (Methods and Principles in Medicinal Chemistry). Wiley-VCH; 2007.
Marshall et al., Back to the future: ribonuclease A. Biopolymers. 2008;90(3):259-77.
McGahon, et al. The end of the (cell) line: methods for the study of apoptosis in vitro. Methods Cell Biol. 1995;46:153-85.
McKern et al., Structure of the insulin receptor ectodomain reveals a folded-over conformation. Nature. Sep. 14, 2006;443(7108):218-21. Epub Sep. 6, 2006.
McNamara et al., Peptides constrained by an aliphatic linkage between two C(alpha) sites: design, synthesis, and unexpected conformational properties of an i,(i + 4)-linked peptide. J Org Chem. Jun. 29, 2001;66(13):4585-94.
Menting et al., A thermodynamic study of ligand binding to the first three domains of the human insulin receptor: relationship between the receptor alpha-chain C-terminal peptide and the site 1 insulin mimetic peptides. Biochemistry. Jun. 16, 2009;48(23):5492-500. doi: 10.1021/bi900261q.
Meyers et al., Formation of mutually exclusive Rabll complexes with members of the family of Rabll-interacting proteins regulates Rabll endocytic targeting and function. J Biol Chem. Dec. 13, 2002;277(50):49003-10. Epub Oct. 9, 2002.
Miloux, et al. Cloning of the human IL-13R alphal chain and reconstitution with the IL4R alpha of a functional IL-4/IL-13 receptor complex. FEBS Lett. Jan. 20, 1997;401(2-3):163-6.
Miyaoka, et al. Increased expression of Wnt-1 in schizophrenic brains. Schizophr Res. Jul. 27, 1999;38(1):1-6.
Moellering, et al. Direct inhibition of the NOTCH transcription factor complex. Nature. Nov. 12, 2009;462(7270):182-8.
Moon, et al. WNT and beta-catenin signalling: diseases and therapies. Nat Rev Genet. Sep. 2004;5(9):689-699.
Morin. beta-catenin signaling and cancer. Bioessays. Dec. 1999;21(12):1021-30.
Mosberg, et al. Dithioeter-containing cyclic peptides. J. Am. Chem. Soc. 1985;107(10):2986-2987.
Moy, et al. Solution structure of human IL-13 and implication for receptor binding. J Mol Biol. Jun. 29, 2001;310(1):219-30.
Muchmore, et al. X-ray and NMR structure of human Bcl-xL, an inhibitor of programmed cell death. Nature. May 23, 1996;381(6580):335-41.
Mudher, et al. Alzheimer's disease-do tauists and baptists fmally shake hands? Trends Neurosci. Jan. 2002;25(1):22-6.
Muir, et al. Expressed protein ligation: a general method for protein engineering. Proc Natl Acad Sci U S A. Jun. 9, 1998;95(12):6705-10.
Muir. Semisynthesis of proteins by expressed protein ligation. Annu Rev Biochem. 2003;72:249-89.
Mustapa, et al. Synthesis of a cyclic peptide containing norlanthionine: effect of the thioether bridge on peptide conformation. J Org Chem. Oct. 17, 2003;68(21):8193-8.
Mynarcik et al., Alanine-scanning mutagenesis of a C-terminal ligand binding domain of the insulin receptor alpha subunit. J Biol Chem. Feb. 2, 1996;271(5):2439-42.
Mynarcik et al., Identification of common ligand binding determinants of the insulin and insulin-like growth factor 1 receptors. Insights into mechanisms of ligand binding. J Biol Chem. Jul. 25, 1997;272(30):18650-5.
Myung, et al. The ubiquitin-proteasome pathway and proteasome inhibitors. Med Res Rev. Jul. 2001;21(4):245-73.
Nair, et al. X-ray structures of Myc-Max and Mad-Max recognizing DNA. Molecular bases of regulation by proto-oncogenic transcription factors. Cell. Jan. 24, 2003;112(2):193-205.
Nakashima, et al. Cross-talk between Wnt and bone morphogenetic protein 2 (BMP-2) signaling in differentiation pathway of C2C12 myoblasts. J Biol Chem. Nov. 11, 2005;280(45):37660-8. Epub Sep. 2, 2005.
Nelson & Kallenbach, "Persistence of the α-Helix Stop Signal in the S-Peptide in Trifluoroethanol Solutions," Biochemistry 28:5256-5261 (1989).
Ngo et al., Computational complexity, protein structure prediction, and the levinthal paradox. In: The Protein Folding Problem and Tertiary Structure Prediction. K. Mem, Jr., et al. Eds. 1994:433506.
Niemann, et al. Homozygous WNT3 mutation causes tetra-amelia in a large consanguineous family. Am J Hum Genet. Mar. 2004;74(3):558-63. Epub Feb. 5, 2004.
Nilsson, et al. Staudinger ligation: a peptide from a thioester and azide. Org Lett. Jun. 29, 2000;2(13):1939-41.
Nishisho, et al. Mutations of chromosome 5q21 genes in FAP and colorectal cancer patients. Science. Aug. 9, 1991;253(5020):665-9.
Node, et al. Hard acid and soft nucleophile systems. 3. Dealkylation of esters with aluminum halide-thiol and aluminum halide-sulfide stustems. J Org Chem. 1981;46:1991-93.
Non-Final Office Action dated Dec. 5, 2008 from U.S. Appl. No. 10/981,873.
Notice of allowance dated Aug. 1, 2014 for U.S. Appl. No. 13/767,852.
Notice of Allowance, mailed Aug. 6, 2012, in U.S. Appl. No. 12/796,212.
O'Neil & DeGrado, "A Thermodynamic Scale for the Helix-forming Tendencies of the Commonly Occurring Amino Acids," Science 250:646-651(1990).
Office action dated Jan. 3, 2013 for U.S. Appl. No. 12/593,384.
Office action dated Jan. 13, 2014 for U.S. Appl. No. 13/767,857.
Office action dated Jan. 17, 2014 for U.S. Appl. No. 13/816,880.
Office action dated Jan. 26, 2009 for U.S. Appl. No. 11/148,976.
Office Action dated Jan. 30, 2008 for U.S. Appl. No. 10/981,873.
Office action dated Feb. 6, 2014 for U.S. Appl. No. 13/680,905.
Office action dated Feb. 9, 2012 for U.S. Appl. No. 12/420,816.
Office action dated Feb. 17, 2011 for U.S. Appl. No. 12/796,212.
Office action dated Mar. 22, 2013 for U.S. Appl. No. 12/233,555.
Office action dated Apr. 9, 2014 for U.S. Appl. No. 13/767,852.
Office action dated Apr. 18, 2011 for U.S. Appl. No. 12/182,673.
Office action dated Jun. 28, 2012 for U.S. Appl. No. 12/233,555.
Office action dated Jul. 15, 2013 for U.S. Appl. No. 13/570,146.

(56) References Cited

OTHER PUBLICATIONS

Office action dated Jul. 16, 2014 for U.S. Appl. No. 13/767,857.
Office action dated Jul. 21, 2014 for U.S. Appl. No. 13/370,057.
Office action dated Aug. 9, 2010 for U.S. Appl. No. 12/182,673.
Office action dated Sep. 18, 2013 for U.S. Appl. No. 13/767,857.
Office action dated Sep. 23, 2013 for U.S. Appl. No. 13/680,905.
Office action dated Oct. 10, 2013 for U.S. Appl. No. 13/816,880.
Office action dated Oct. 18, 2011 for U.S. Appl. No. 12/796,212.
Office action dated Nov. 5, 2002 for U.S. Appl. No. 09/574,086.
Office action dated Nov. 25, 2009 for U.S. Appl. No. 11/148,976.
Office action dated Dec. 29, 2011 for U.S. Appl. No. 12/233,555.
Office action dated Dec. 31, 2013 for U.S. Appl. No. 12/525,123.
Office Communication, mailed Feb. 9, 2012, for U.S. Appl. No. 12/420,816.
Office Communication, mailed Oct. 18, 2011, for U.S. Appl. No. 12/796,212.
Okamura, et al. Redundant regulation of T cell differentiation and TCRalpha gene expression by the transcription factors LEF-1 and TCF-1. Immunity Jan. 1998;8(1):11-20.
Olson, et al. Sizing up the heart: development redux in disease. Genes Dev. Aug. 15, 2003;17(16):1937-56. Epub Jul. 31, 2003.
Or et al. Cysteine alkylation in unprotected peptides: synthesis of a carbavasopressin analogue by intramolecular cystein alkylation. J. Org. Chem. Apr. 1991;56(9):3146-3149.
Ösapay & Taylor, "Multicyclic Polypeptide Model Compounds. 2. Synthesis and Conformational Properties of a Highly α-Helical Uncosapeptide Constrained by Three Side-chain to Side-chain Lactam Bridges," J. Am. Chem. Soc. 114:6966-6973 (1992).
Pakotiprapha, et al. Crystal structure of Bacillus stearothermophilus UvrA provides insight into ATP-modulated dimerization, UvrB interaction, and DNA binding. Mol Cell. Jan. 18, 2008;29(1):122-33.
Paquette. Encyclopedia of Reagents for Organic Synthesis. John Wiley and Sons. 1995.
Pazgier, et al. Structural basis for high-affinity peptide inhibition of p53 interactions with MDM2 and MDMX. Proc Natl Acad Sci U S A. Mar. 24, 2009;106(12):4665-70. doi: 10.1073/pnas.0900947106. Epub Mar. 2, 2009.
Pellois, et al. Semisynthetic proteins in mechanistic studies: using chemistry to go where nature can't Curr. Opin. Chem. Biol. 2006; 10(5):487-91.
Perantoni. Renal development: perspectives on a Wnt-dependent process. Semin Cell Dev Biol. Aug. 2003;14(4):201-8.
Peryshkov, et al. Z-Selective olefin metathesis reactions promoted by tungsten oxo alkylidene complexes. J Am Chem Soc. Dec. 28, 2011;133(51):20754-7. doi: 10.1021/ja210349m. Epub Nov. 30, 2011.
Phan, et al. Structure-based design of high affinity peptides inhibiting the interaction of p53 with MDM2 and MDMX. J Biol Chem. Jan. 15, 2010;285(3):2174-83. doi: 10.1074/jbc.M109.073056. Epub Nov. 12, 2009.
Phelan, et al. A general method for constraining short peptides to an alpha-helical conformation. J Am Chem Soc. 1997; 119(3):455-60.
Phelan, et al. A General Method For Constraining Short Peptides to an α-Helical Conformation. J. Am. Chem. Soc. 1997;119:455-460.
Picksley, et al Immunochemical analysis of the interaction of p53 with MDM2;—fine mapping of the MDM2 binding site on p53 using synthetic peptides. Oncogene. Sep. 1994;9(9):2523-9.
Pillutla et al., Peptides identify the critical hotspots involved in the biological activation of the insulin receptor. J Biol Chem. Jun. 21, 2002;277(25):22964-4. Epub Apr. 18, 2002.
Polakis. The oncogenic activation of beta-catenin. Curr Opin Genet Dev. Feb. 1999;9(1):15-21.
Punna, et al. Head-to-tail peptide cyclodimerization by copper-catalyzed azide-alkyne cycloaddition. Angew Chem Int Ed Engl. Apr. 8, 2005;44(15):2215-20.
Qiu, et al. Convenient, large-scale asymmetric synthesis of enantiomerically pure trans-cinnamylglycine and -alpha-alanine. Tetrahedron. 2000; 56:2577-82.

Rasmussen, et al. Ruthenium-catalyzed cycloaddition of aryl azides and alkynes. Org. Lett. Dec. 20, 2007;9(26):5337-5339.
Rawlinson, et al. CRM1-mediated nuclear export of dengue virus RNA polymerase NS5 modulates interleukin-8 induction and virus production. J Biol Chem. Jun. 5, 2009;284(23):15589-97.
Reya, et al. Wnt signalling in stem cells and cancer. Nature. Apr. 14, 2005;434(7035):843-50.
Rich, et al. Synthesis of the cytostatic cyclic tetrapeptide, chlamydocin. Tetranderon Letts. 1983;24(48):5305-08.
Roberts, et al. Efficient synthesis of thioether-based cyclic peptide libraries. Tetrahedon Letters. 1998; 39: 8357-8360.
Roberts, et al. Examination of methodology for the synthesis of cyclic thioether peptide libraries derived from linear tripeptides. J Pept Sci. Dec. 2007;13(12):811-21.
Robitaille, et al. Mutant frizzled-4 disrupts retinal angiogenesis in familial exudative vitreoretinopathy. Nat Genet. Oct. 2002;32(2):326-30. Epub Aug. 12, 2002.
Rodova, et al. The polycystic kidney disease-1 promoter is a target of the beta-catenin/T-cell factor pathway. J Biol Chem. Aug. 16, 2002;277(33):29577-83. Epub Jun. 4, 2002.
Roos, et al. Synthesis of alpha-substituted alpha-amino acids via cationic intermediates. J Org Chem. 1993; 58:3259-68.
Ross, et al. Inhibition of adipogenesis by Wnt signaling. Science. Aug. 11, 2000;289(5481):950-3.
Rostovtsev, et al. A stepwise huisgen cycloaddition process: copper (i)-catalyzed regioselective "ligation" of azides and terminal alkynes. Angew. Chem. Int. Ed. Engl. Jul. 15, 2002;41(14):2596-2599.
Ruan et al., "Metal Ion Enhanced Helicity in Synthetic Peptides Containing Unnatural, Metal-ligating Residues," J. Am. Chem. Soc. 112:9403-9404 (1990).
Rudinger, Characteristics of the amino acids as components of a peptide hormone sequence. In: Peptide Hormones. J. A. Parsons, ed. University Park Press. Jun. 1976:1-7.
Ruffolo and Shore. BCL-2 Selectively Interacts with the BID-Induced Open Conformer of BAK, Inhibiting BAK Auto-Oligomerization. J. Biol. Chem. 2003;278(27):25039-25045.
Sadot, et al. Down-regulation of beta-catenin by activated p53. Mol. Cell Biol. 2001;21(20):6768-81.
Sampietro, et al. Crystal structure of a beta-catenin/BCL9/Tcf4 complex. Mol Cell. Oct. 20, 2006;24(2):293-300.
Sanchez-Garcia, et al. Tumorigenic activity of the BCR-ABL oncogenes is mediated by BCL2. Proc Natl Acad Sci U S A. Jun. 6, 1995;92(12):5287-91.
Satoh, et al. AXIN1 mutations in hepatocellular carcinomas, and growth suppression in cancer cells by virus-mediated transfer of AXIN1. Nat Genet. Mar. 2000;24(3):245-50.
Sattler, et al. Structure of Bcl-xL-Bak peptide complex: recognition between regulators of apoptosis. Science. Feb. 14, 1997;275(5302):983-6.
Saxon, et al. Cell surface engineering by a modified Staudinger reaction. Science. Mar. 17, 2000;287(5460):2007-10.
Schaffer et al., A novel high-affinity peptide antagonist to the insulin receptor. Biochem Biophys Res Commun. Nov. 14, 2008;376(2):380-3. doi: 10.1016/j.bbrc.2008.08.151. Epub Sep. 7, 2008.
Schaffer et al., Assembly of high-affinity insulin receptor agonists and antagonists from peptide building blocks. Proc Natl Acad Sci U S A. Apr. 15, 2003;100(8):4435-9. Epub Apr. 8, 2003.
Schafmeister, et al. An all-hydrocarbon cross-linking system for enhancing the helicity and metabolic stability of peptides. Journal of the American Chemical Society. 2000;122(24):5891-5892.
Scheffzek, et al. The Ras-RasGAP complex: structural basis for GTPase activation and its loss in oncogenic Ras mutants. Science. Jul. 18, 1997;277(5324):333-8.
Schinzel et al., The phosphate recognition site of *Escherichia coli* maltodextrin phosphorylase. FEBS Lett. Jul. 29, 1991;286(1-2):125-8.
Schmiedeberg et al., Reversible backbone protection enables combinatorial solid-phase ring-closing metathesis reaction (RCM) in peptides. Org Lett. Jan. 10, 2002;4(1):59-62.
Scholtz, et al. The mechanism of alpha-helix formation by peptides. Annu Rev Biophys Biomol Struct. 1992;21:95-118.

(56) References Cited

OTHER PUBLICATIONS

Schrock, et al. Tungsten(VI) neopentylidyne complexes. Organometallics. 1982; 1:1645-51.

Schwarzer, et al. Protein semisynthesis and expressed protein ligation: chasing a protein's tail. Curr. Opin. Chem. Biol. 2005; 9(6):561-9.

Scorrano, et al. A distinct pathway remodels mitochondrial cristae and mobilizes cytochrome c during apoptosis. Dev Cell. Jan. 2002;2(1):55-67.

Seabra et al., Rab GTPases, intracellular traffic and disease. Trends Mol Med. Jan. 2002;8(1):23-30.

Seebach, et al. Self-Regeneration of Stereocenters (SRS)—Applications, Limitations, and Abandonment of a Synthetic Principle. Angew. Chem. Int. Ed. Engl. 1996;35:2708-2748.

Shair. A closer view of an oncoprotein-tumor suppressor interaction. Chem Biol. Nov. 1997;4(11):791-4.

Shepherd et al., "Single Turn Peptide Alpha Helices with Exceptional Stability in Water," J. Am. Chem. Soc. 127:2974-2983 (2005).

Shiba et al., Structural basis for Rab11-dependent membrane recruitment of a family of Rab11interacting protein 3 (FIP3)/Arfophilin-1. Proc Natl Acad Sci U S A. Oct. 17, 2006;103(42):1541621. Epub Oct. 9, 2006.

Si, et al. CCN1/Cyr61 is regulated by the canonical Wnt signal and plays an important role in Wnt3A-induced osteoblast differentiation of mesenchymal stem cells. Mol Cell Biol. Apr. 2006;26(8):2955-64.

Sia et al., "Short Constrained Peptides that Inhibit HIV-1 Entry," Proc. Nat'l Acad. Sci. USA 99(23):14664-14669 (2002).

Siddle et al., Specificity in ligand binding and intracellular signalling by insulin and insulin-like growth factor receptors. Biochem Soc Trans. Aug. 2001;29(Pt 4):513-25.

Skinner et al., Basic helix-loop-helix transcription factor gene family phylogenetics and nomenclature. Differentiation. Jul. 2010;80(1):1-8. doi: 10.1016/j.diff.2010.02.003. Epub Mar. 10, 2010.

Smith et al., Structural resolution of a tandem hormone-binding element in the insulin receptor and its implications for design of peptide agonists. Proc Natl Acad Sci U S A. Apr. 13, 2010;107(15):6771-6. doi: 10.1073/pnas.1001813107. Epub Mar. 26, 2010.

Soucek, et al. Modelling Myc inhibition as a cancer therapy. Nature. Oct. 2, 2008;455(7213):679-83.

Spierings, et al. Connected to death: the (unexpurgated) mitochondrial pathway of apoptosis. Science. 2005; 310:66-67.

Stein et al., Rab proteins and endocytic trafficking: potential targets for therapeutic intervention. Adv Drug Deliv Rev. Nov. 14, 2003;55(11):1421-37.

Stenmark et al., The Rab GTPase family. Genome Biol. 2001;2(5):3007.1-3007.7.

Stewart, et al. Cell-penetrating peptides as delivery vehicles for biology and medicine. Org Biomol Chem. Jul. 7, 2008;6(13):2242-55. doi: 10.1039/b719950c. Epub Apr. 15, 2008.

Still, et al. Semianalytical treatment of solvation for molecular mechanics and dynamics. J Am Chem Soc. 1990; 112:6127-29.

Stueanaes et al., Beta-adrenoceptor stimulation potentiates insulin-stimulated PKB phosphorylation in rat cardiomyocytes via cAMP and PKA. Br J Pharmacol. May 2010;160(1):116-29. doi: 10.1111/j.1476-5381.2010.00677.x.

Su, et al. Eradication of pathogenic beta-catenin by Skp1/Cullin/F box ubiquitination machinery. Proc Natl Acad Sci U S A. Oct. 28, 2003;100(22):12729-34. Epub Oct. 16, 2003.

Surinya et al., Role of insulin receptor dimerization domains in ligand binding, cooperativity, and modulation by anti-receptor antibodies. J Biol Chem. May 10, 2002;277(19):16718-25. Epub Mar. 1, 2002.

Suzuki, et al. Structure of Bax: coregulation of dimer formation and intracellular localization. Cell. Nov. 10, 2000;103(4):645-54.

Szewczuk, et al. Synthesis and biological activity of new conformationally restricted analogues of pepstatin. Int. J. Pept. Protein Res. Sep.-Oct. 1992;40(3-4):233-42.

Takeda, et al. Human sebaceous tumors harbor inactivating mutations in LEF1. Nat Med. Apr. 2006;12(4):395-7. Epub Mar. 26, 2006.

Tanaka, Design and synthesis of non-proteinogenic amino acids and secondary structures of their peptides. Yakugaku Zasshi. Oct. 2006:126(10):931-44. Japanese.

Taylor. The synthesis and study of side-chain lactam-bridged peptides. Biopolymers. 2002;66(1):49-75.

Thompson, et al. Mutants of interleukin 13 with altered reactivity toward interleukin 13 receptors. J Biol Chem. 1999; 275(42):29944-50.

Tian, et al. The role of the Wnt-signaling antagonist DKK1 in the development of osteolytic lesions in multiple myeloma. N Engl J Med. Dec. 25, 2003;349(26):2483-94.

Titus, et al. Human K/natural killer cells targeted with hetero-cross-linked antibodies specifically lyse tumor cells in vitro and prevent tumor growth in vivo. J Immunol Nov. 1, 1987;139(9):3153-8.

Tolbert, et al. New methods for proteomic research: preparation of protein with N-terminal cysteines for labeling and conjugation. Angew Chem. Int. Ed. Engl. 2002; 41(12):2171-4.

Toomes, et al. Mutations in LRP5 or FZD4 underlie the common familial exudative vitreoretinopathy locus on chromosome 11q. Am J Hum Genet. Apr. 2004;74(4):721-30. Epub Mar. 2004.

Tornoe et al., Peptidotriazoles on solid phase: [1,2,3]-triazoles by regiospecific copper(i)catalyzed 1,3-dipolar cycloadditions of terminal alkynes to azides. J Org Chem. May 3, 2002;67(9):3057-64.

Torrance, et al. Combinatorial chemoprevention of intestinal neoplasia. Nat Med. Sep. 2000;6(9):1024-8.

Trnka & Grubbs, "The Development of L2X2Ru=CHR Olefin Metathesis Catalysts: An Organometallic Success Story," Acc. Chem. Res. 34:18-29 (2001).

Tsuji, et al. Antiproliferative activity of REIC/Didc-3 and its significant down-regulation in non-small-cell lung carcinomas. Biochem Biophys Res Commun. Nov. 23, 2001;289(1):257-63.

Tugyi, et al. The effect of cyclization on the enzymatic degradation of herpes simplex virus glycoprotein D derived epitope peptide. J Pept Sci. Oct. 2005;11(10):642-9.

Tyndall et al. Macrocycles mimic the extended peptide conformation recognized by aspartic, serine, cysteine and metallo proteases. Curr Med Chem. Jul. 2001;8(8):893-907.

Uesugi, et al. The alpha-helical FXXPhiPhi motif in p53: TAF interaction and discrimination by MDM2. Proc Natl Acad Sci U S A. Dec. 21, 1999;96(26):14801-6.

Vaickus, et al. Immune markers in hematologic malignancies.Crit Rev Oncol Hematol. Dec. 1991;11(4):267-97.

Van Genderen, et al. Development of several organs that require inductive epithelial-mesenchymal interactions is impaired in LEF-1-deficient mice. Genes Dev. Nov. 15, 1994;8(22):2691-703.

Van Gun, et al.,The wnt-frizzled cascade in cardiovascular disease. Cardiovasc Res. Jul. 2002;55(1):16-24.

Varallo, et al. Beta-catenin expression in Dupuytren's disease: potential role for cell-matrix interactions in modulating beta-catenin levels in vivo and in vitro. Oncogene. Jun. 12, 2003;22(24):3680-4.

Vartak, et al. Allosteric modulation of the dopamine receptor by conformationally constrained type VI B-turn peptidomimetics of Pro-Leu-Gly-NH2. J. Med. Chem. 2007; 50(26):6725-6729.

Venancio, et al.Reconstructing the ubiquitin network: cross-talk with other systems and identification of novel functions. Genome Biol. 2009;10(3):R33.

Verdine, et al. The challenge of drugging undruggable targets in cancer: lessons learned from targeting BCL-2 family members. Clin Cancer Res. Dec. 15, 2007;13(24):7264-70.

Verma, et al. Small interfering RNAs directed against beta-catenin inhibit the in vitro and in vivo growth of colon cancer cells. Clin Cancer Res. Apr. 2003;9(4):1291-300.

Viallet, et al. Tallimustine is inactive in patients with previously treated small cell lung cancer. A phase II trial of the National Cancer Institute of Canada Clinical Trials Group. Lung Cancer. Nov. 1996;15(3):367-73.

Voet et al., Biochemistry. Second Edition. John Wiley & Sons, Inc. 1995:235-241.

Walensky, et al. A stapled BID BH3 helix directly binds and activates BAX. Mol Cell. Oct. 20, 2006;24(2):199-210.

(56) References Cited

OTHER PUBLICATIONS

Walensky, et al. Activation of Apoptosis in Vivo by a Hydrocarbon-Stapled BH3 Helix. Science. Sep. 3, 2004;305(5689):1466-1470.
Walter, et al. Critical role for IL-13 in the development of allergen-induced airway hyperreactivity. J Immunol. Oct. 15, 2001;167(8):4668-75.
Wang et al. Cell permeable Bcl-2 binding peptides: a chemical approach to apoptosis induction in tumor cells. Cancer Res. Mar. 15, 2000;60(6):1498-502.
Wang et al. Enhanced metabolic stability and protein-binding properties of artificial alpha helices derived from a hydrogen-bond surrogate: application to Bcl-xL. Angew Chem Int Ed Engl. Oct. 14, 2005;44(40):6525-9.
Wang, 4-Alkyl-2-trichloromethyloxazolidin-5-ones: Valuable Precursors to Enantiomerically Pure C- and N-Protected a-Alkyl Prolines. Synlett. 1999;1:33-36.
Wang, et al. BID: a novel BH3 domain-only death agonist. Genes Dev. Nov. 15, 1996;10(22):2859-69.
Wang, et al. Evaluation of biologically relevant short alpha-helices stabilized by a main-chain hydrogen-bond surrogate. J Am Chem Soc. Jul. 19, 2006;128(28):9248-56.
Wang, et al. Inhibition of p53 degradation by Mdm2 acetylation. FEBS Lett. Mar. 12, 2004;561(1-3):195-201.
Wang, et al. Nucleation and stability of hydrogen-bond surrogate-based alpha-helices. Org Biomol Chem. Nov. 21, 2006;4(22):4074-81.
Wei et al., Disorder and structure in the Rab11 binding domain of Rab11 family interacting protein 2. Biochemistry. Jan. 27, 2009;48(3):549-57. doi: 10.1021/bi8020197.
Wei, et al. tBID, a membrane-targeted death ligand, oligomerizes BAK to release cytochrome c. Genes Dev. Aug. 15, 2000;14(16):2060-71.
Wild et al., "Peptides Corresponding to a Predictive α-Helical Domain of Human Immunodeficiency Virus Type 1 gp41 are Potent Inhibitors of Virus Infection," Proc. Nat'l Acad. Sci. USA 91:9770-9774 (1994).
Wilen, et al. Strategies in optical resolution. Tetrahedron. 1977; 33:2725-36.
Wilen, Tables of Resolving Agents and Optical Resolutions. E.L. Eliel, ed. Universtify of Notre Dame Press, Notre Dame, IN. 1972:268-98.
Williams, et al. Asymmetric Synthesis of Monosubstituted and a,a-Disubstituted a-Amino Acids via Diastereoselective Glycine Enolate Allcylations. J Am Chem Soc. 1991;113:9276-86.
Wills-Karp, et al. Interleukin-13: central mediator of allergic asthma. Science. Dec. 18, 1998;282(5397):2258-61.
Wills-Karp. Interleukin-13 in asthma pathogenesis. Immunol Rev. 2004; 202:175-90.
Wills-Karp. The gene encoding interleukin-13: a susceptibility locus for asthma and related traits. Respir Res. 2000;1(1):19-23.
Wilson et al., The FIP3-Rab11 protein complex regulates recycling endosome targeting to the cleavage furrow during late cytokinesis. Mol Biol Cell. Feb. 2005;16(2):849-60. Epub Dec. 15, 2004.
Woon, et al. Linking of 2-oxoglutarate and substrate binding sites enables potent and highly selective inhibition of JmjC histone demethylases. Angew Chem Int Ed Engl. Feb. 13, 2012;51(7):1631-4. doi: 10.1002/anie.201107833. Epub Jan. 12, 2012.
Wu, et al. Regiospecific Synthesis of 1,4,5-Trisubstituted-1,2,3-triazole via One-Pot Reaction Promoted by Copper(I) Salt. Synthesis. 2005(8): 1314-1318.
Xi, et al. Use of DNA and peptide nucleic acid molecular beacons for detection and quantification of rRNA in solution and in whole cells. Appl Environ Microbiol. Sep. 2003, 69(9):5673-8.
Xing, et al. Crystal structure of a beta-catenin/axin complex suggests a mechanism for the beta-catenin destruction complex. Genes Dev. Nov. 15, 2003;17(22):2753-64. Epub Nov. 4, 2003.
Yang, et al. Calculation of protein conformation from circular dichroism. Methods Enzymol. 1986;130:208-69.
Yang, et al. Synthesis and helical structure of lactam bridged BH3 peptides derived from pro-apoptotic Bcl2 family proteins. Bioorg Med Chem Lett. 2004; 14:1403-06.
Yang, et al. Therapeutic dosing with anti-interleukin-13 monoclonal antibody inhibits asthma progression in mice. J Pharmacol Exp Ther. Apr. 2005;313(1):8-15.
Yu, et al. Synthesis of macrocyclic natural products by catalyst-controlled stereoselective ring-closing metathesis. Nature. Nov. 2, 2011;479(7371):88-93. doi: 10.1038/nature10563.
Yu, et al. The role of Axin2 in calvarial morphogenesis and craniosynostosis. Development. Apr. 2005;132(8):1995-2005.
Zamzami et al. The thiol crosslinking agent diamide overcomes the apoptosis-inhibitory effect of Bcl-2 by enforcing mitochondrial permeability transition. Oncogene. Feb. 26, 1998;16(8):1055-63.
Zhang, et al. 310 Helix versus alpha-helix: a molecular dynamics study of conformational preferences of Aib and Alanine. J. American Cancer Society. Dec. 1994; 116(26):11915-11921.
Zhang, et al. Ruthenium-catalyzed cycloaddition of alkynes and organic azides. J. Am. Chem. Soc. Nov. 23, 2005;127(46):15998-9.
Zhou, et al. Identification of ubiquitin target proteins using cell-based arrays. J Proteome Res. 2007; 6:4397-4406.
Zhou, et al. Lymphoid enhancer factor 1 directs hair follicle patterning and epithelial cell fate. Genes Dev. Mar. 15, 1995;9(6):700-13.
Zhou, et al. Tyrosine kinase inhibitor STI-571/Gleevec down-regulates the betacatenin signaling activity. Cancer Lett. Apr. 25, 2003;193(2):161-70.
Zimm et al., Theory of the Phase Transition between Helix and Random Coil in Polypeptide Chains. J Chem Phys. 1959;31:526-35.
Zor, et al. Solution structure of the KIX domain of CBP bound to the transactivation domain of c-Myb. J Mol Biol. Mar. 26, 2004;337(3):521-34.
Co-pending U.S. Appl. No. 14/718,288, filed May 21, 2015.
Co-pending U.S. Appl. No. 14/750,649, filed Jun. 25, 2015.
Co-pending U.S. Appl. No. 14/843,079, filed Sep. 2, 2015.
Co-pending U.S. Appl. No. 14/852,368, filed Sep. 11, 2015.
Co-pending U.S. Appl. No. 14/853,894, filed Sep. 14, 2015.
Co-pending U.S. Appl. No. 14/864,687, filed Sep. 24, 2015.
Co-pending U.S. Appl. No. 14/864,801, filed Sep. 24, 2015.
Co-pending U.S. Appl. No. 14/866,445, filed Sep. 25, 2015.
European search report and search opinion dated Sep. 30, 3015 for EP Application No. 13749501-6.
European search report and search opinion dated Oct. 5, 2015 for EP Application No. 13748983-7.
Fustero, et al. Asymmetric synthesis of new beta,beta-difluorinated cyclic quaternary alpha-amino acid derivatives. Org Lett. Aug. 31, 2006;8(18):4129-32.
Hase, et al. 1,6-Aminosuberic acid analogs of lysine- and arginine-vasopressin and -vasotocin. Synthesis and biological properties. J Am Chem Soc. May 17, 1972;94(10):3590-600.
Li, et al. A versatile platform to analyze low-affinity and transient protein-protein interactions in living cells in real time. 2014, 9(5):, 1946-58.
Notice of allowance dated Jun. 12, 2014 for U.S. Appl. No. 12/525,123.
Notice of allowance dated Nov. 6, 2014 for U.S. Appl. No. 13/767,857.
Office action dated Mar. 26, 2015 for U.S. Appl. No. 14/070,354.
Office action dated Apr. 10, 2015 for U.S. Appl. No. 14/460,848.
Office action dated Jul. 24, 2015 for U.S. Appl. No. 13/252,751.
Office action dated Sep. 2, 2015 for U.S. Appl. No. 14/608,641.
Office action dated Dec. 19, 2014 for U.S. Appl. No. 14/068,844.
Office Communication, mailed Jan. 3, 2013, for U.S. Appl. No. 12/593,384.
STN search notes for Lu reference, 4 pages, 2006.
Notice of allowance dated Oct. 23, 1015 for U.S. Appl. No. 13/252,751.
Guo et al., Probing the alpha-helical structural stability of stapled p53 peptides: molecular dynamics simulations and analysis. Chem Biol Drug Des. Apr. 2010;75(4):348-59. doi: 10.1111/j.1747-0285. 2010.00951.x.

(56) References Cited

OTHER PUBLICATIONS

Kim et al., Introduction of all-hydrocarbon i,i+3 staples into alpha-helices via ring-closing olefin metathesis. Org Lett. Jul. 2, 2010;12(13):3046-9. doi: 10.1021/ol1010449.

Miller et al., Application of Ring-Closing Metathesis to the Synthesis of Rigidified Amino Acids and Peptides. J Am Chem Soc. 1996;118(40):9606-9614.

Miller et al., Synthesis of Conformationally Restricted Amino Acids and Peptides Employing Olefin Metathesis. J Am Chem Soc. 1995;117(21):5855-5856.

Muppidi et al., Conjugation of spermine enhances cellular uptake of the stapled peptide-based inhibitors of p53-Mdm2 interaction. Bioorg Med Chem Lett. Dec. 15, 2011;21(24):7412-5. doi: 10.1016/j.bmcl.2011.10.009. Epub Oct. 12, 2011.

* cited by examiner

PEPTIDOMIMETIC MACROCYCLES

CROSS-REFERENCE

This application is a continuation of U.S. Utility application Ser. No. 13/767,852, filed Feb. 14, 2013, which claims the benefit of U.S. Provisional Application Nos. 61/599,328, filed Feb. 15, 2012, U.S. Provisional Application No. 61/656,962, filed Jun. 7, 2012, and U.S. Provisional Application No. 61/723,770, filed Nov. 7, 2012; all of which are incorporated herein by reference in their entirety.

SEQUENCE LISTING

The instant application contains a Sequence Listing which has been submitted in ASCII format via EFS-Web and is hereby incorporated by reference in its entirety. Said ASCII copy, created on Apr. 24, 2016, is named 35224-766.301_SL.txt and is 1,202,889 bytes in size.

BACKGROUND OF THE INVENTION

The human transcription factor protein p53 induces cell cycle arrest and apoptosis in response to DNA damage and cellular stress, and thereby plays a critical role in protecting cells from malignant transformation. The E3 ubiquitin ligase MDM2 (also known as HDM2) negatively regulates p53 function through a direct binding interaction that neutralizes the p53 transactivation activity, leads to export from the nucleus of p53 protein, and targets p53 for degradation via the ubiquitylation-proteasomal pathway. Loss of p53 activity, either by deletion, mutation, or MDM2 overexpression, is the most common defect in human cancers. Tumors that express wild type p53 are vulnerable to pharmacologic agents that stabilize or increase the concentration of active p53. In this context, inhibition of the activities of MDM2 has emerged as a validated approach to restore p53 activity and resensitize cancer cells to apoptosis in vitro and in vivo. MDMX (MDM4) has more recently been identified as a similar negative regulator of p53, and studies have revealed significant structural homology between the p53 binding interfaces of MDM2 and MDMX. The p53-MDM2 and p53-MDMX protein-protein interactions are mediated by the same 15-residue alpha-helical transactivation domain of p53, which inserts into hydrophobic clefts on the surface of MDM2 and MDMX. Three residues within this domain of p53 (F19, W23, and L26) are essential for binding to MDM2 and MDMX.

There remains a considerable need for compounds capable of binding to and modulating the activity of p53, MDM2 and/or MDMX. Provided herein are p53-based peptidomimetic macrocycles that modulate an activity of p53. Also provided herein are p53-based peptidomimetic macrocycles that inhibit the interactions between p53, MDM2 and/or MDMX proteins. Further, provided herein are p53-based peptidomimetic macrocycles that can be used for treating diseases including but not limited to cancer and other hyperproliferative diseases.

SUMMARY OF THE INVENTION

Described herein are stably cross-linked peptides related to a portion of human p53 ("p53 peptidomimetic macrocycles"). These cross-linked peptides contain at least two modified amino acids that together form an intramolecular cross-link that can help to stabilize the alpha-helical secondary structure of a portion of p53 that is thought to be important for binding of p53 to MDM2 and for binding of p53 to MDMX. Accordingly, a cross-linked polypeptide described herein can have improved biological activity relative to a corresponding polypeptide that is not cross-linked. The p53 peptidomimetic macrocycles are thought to interfere with binding of p53 to MDM2 and/or of p53 to MDMX, thereby liberating functional p53 and inhibiting its destruction. The p53 peptidomimetic macrocycles described herein can be used therapeutically, for example to treat cancers and other disorders characterized by an undesirably low level or a low activity of p53, and/or to treat cancers and other disorders characterized by an undesirably high level of activity of MDM2 or MDMX. The p53 peptidomimetic macrocycles can also be useful for treatment of any disorder associated with disrupted regulation of the p53 transcriptional pathway, leading to conditions of excess cell survival and proliferation such as cancer and autoimmunity, in addition to conditions of inappropriate cell cycle arrest and apoptosis such as neurodegeneration and immunedeficiencies. In some embodiments, the p53 peptidomimetic macrocycles bind to MDM2 (e.g., GenBank® Accession No.: 228952; GI:228952) and/or MDMX (also referred to as MDM4; GenBank® Accession No.: 88702791; GI:88702791).

In one aspect, provided herein is a peptidomimetic macrocycle comprising an amino acid sequence which is at least about 60%, 80%, 90%, or 95% identical to an amino acid sequence chosen from the group consisting of the amino acid sequences in Table 1, Table 1a, Table 1b, or Table 1c. Alternatively, an amino acid sequence of said peptidomimetic macrocycle is chosen from the group consisting of the amino acid sequences in Table 4. In some embodiments, the peptidomimetic macrocycle is not a peptide as shown in Table 2a or 2b. In other cases, the peptidomimetic macrocycle does not comprise a structure as shown in Table 2a or 2b. In some embodiments, the peptidomimetic macrocycle has an amino acid sequence chosen from Table 1. In some embodiments, the peptidomimetic macrocycle has an amino acid sequence chosen from Table 1a. In some embodiments, the peptidomimetic macrocycle has an amino acid sequence chosen from Table 1b. In some embodiments, the peptidomimetic macrocycle has an amino acid sequence chosen from Table 1c.

Alternatively, an amino acid sequence of said peptidomimetic macrocycle is chosen as above, and further wherein the macrocycle does not include a thioether or a triazole. In some embodiments, the peptidomimetic macrocycle comprises a helix, such as an α-helix. In other embodiments, the peptidomimetic macrocycle comprises an α,α-disubstituted amino acid. A peptidomimetic macrocycle can comprise a crosslinker linking the α-positions of at least two amino acids. At least one of said two amino acids can be an α,α-disubstituted amino acid.

In some embodiments, provided are peptidomimetic macrocycle of the formula:

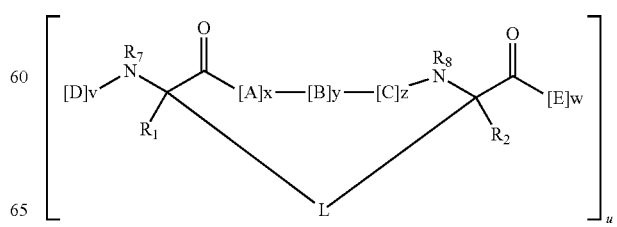

Formula I wherein:
each A, C, D, and E is independently an amino acid;
B is an amino acid,

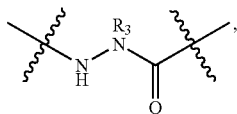

[—NH-L$_3$-CO—], [—NH-L$_3$-SO$_2$—], or [—NH-L$_3$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each L or L' is independently a macrocycle-forming linker of the formula -L$_1$-L$_2$-;

L$_1$ and L$_2$ and L$_3$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

comprise a hydrophobic side chain. For example, the first C-terminal amino acid and/or the second C-terminal amino acid represented by E comprises a hydrophobic side chain, for example a large hydrophobic side chain.

In some embodiments, w is between 3 and 1000. For example, the third amino acid represented by E comprises a large hydrophobic side chain.

In other embodiments, the peptidomimetic macrocycle as claimed excludes the sequence of:

```
                                       (SEQ ID NO: 1)
Ac-RTQATF$r8NQWAibANle$TNAibTR-NH2, (SEQ ID NO: 2)
Ac-RTQATF$r8NQWAibANle$TNAibTR-NH2, (SEQ ID NO: 3)
Ac-$r8SQQTFS$LWRLLAibQN-NH2, (SEQ ID NO: 4)
Ac-QSQ$r8TFSNLW$LLAibQN-NH2, (SEQ ID NO: 5)
Ac-QS$r5QTFStNLW$LLAibQN-NH2,
or
                                       (SEQ ID NO: 6)
Ac-QSQQ$r8FSNLWR$LAibQN-NH2.
```

In other embodiments, the peptidomimetic macrocycle as claimed excludes the sequence of:

```
                                       (SEQ ID NO: 7)
Ac-Q$r8QQTFSN$WRLLAibQN-NH2.
```

Peptidomimetic macrocycles are also provided of the formula:

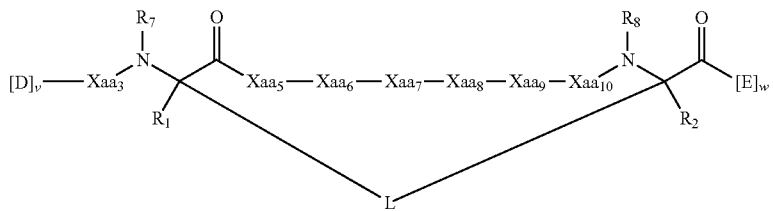

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v and w are independently integers from 1-1000, for example 1-500, 1-200, 1-100, 1-50, 1-30, 1-20, or 1-10;

u is an integer from 1-10, for example 1-5, 1-3 or 1-2;

x, y and z are independently integers from 0-10, for example the sum of x+y+z is 2, 3, or 6; and n is an integer from 1-5.

In some embodiments, w>2 and each of the first two amino acid represented by E comprises an uncharged side chain or a negatively charged side chain.

In some embodiments, the first C-terminal amino acid and/or the second C-terminal amino acid represented by E wherein:
each of Xaa$_3$, Xaa$_5$, Xaa$_6$, Xaa$_7$, Xaa$_8$, Xaa$_9$, and Xaa$_{10}$ is individually an amino acid, wherein at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-His$_5$-Tyr$_6$-Trp$_7$-Ala$_8$-Gln$_9$-Leu$_{10}$-X$_{11}$-Ser$_{12}$ (SEQ ID NO: 8), where each X is an amino acid;

each D and E is independently an amino acid;

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

each L or L' is independently a macrocycle-forming linker of the formula -L$_1$-L$_2$-;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments, a peptidomimetic macrocycle has the Formula:

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

each L or L' is independently a macrocycle-forming linker of the formula -L$_1$-L$_2$-;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

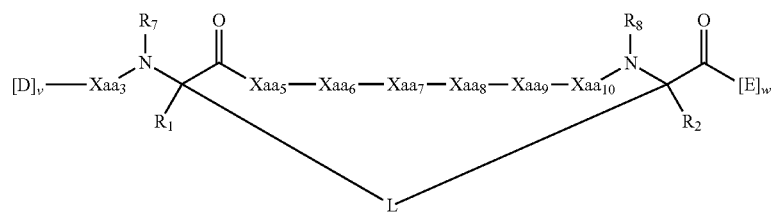

wherein:

each of Xaa$_3$, Xaa$_5$, Xaa$_6$, Xaa$_7$, Xaa$_8$, Xaa$_9$, and Xaa$_{10}$ is individually an amino acid, wherein at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9), where each X is an amino acid;

each D is independently an amino acid;

each E is independently an amino acid, for example an amino acid selected from Ala (alanine), D-Ala (D-alanine), Aib (α-aminoisobutyric acid), Sar (N-methyl glycine), and Ser (serine);

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments, a peptidomimetic macrocycle has the Formula:

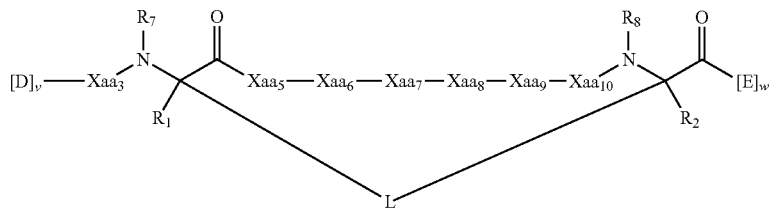

wherein:

each of Xaa₃, Xaa₅, Xaa₆, Xaa₇, Xaa₈, Xaa₉, and Xaa₁₀ is individually an amino acid, wherein at least two of Xaa₃, Xaa₅, Xaa₆, Xaa₈, Xaa₉, and Xaa₁₀ are the same amino acid as the amino acid at the corresponding position of the sequence Phe₃-X₄-Glu₅-Tyr₆-Trp₇-Ala₈-Gln₉-Leu₁₀/Cba₁₀-X₁₁-Ala₁₂ (SEQ ID NO: 9), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L or L' is independently a macrocycle-forming linker of the formula $-L_1-L_2-$, wherein L comprises at least one double bond in the E configuration;

$L_1$ and $L_2$ are independently alkylene, alkenylene, alkynylene, heteroalkylene, cycloalkylene, heterocycloalkylene, cycloarylene, heterocycloarylene, or $[-R_4-K-R_4-]_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each K is O, S, SO, SO₂, CO, CO₂, or CONR₃;

each $R_5$ is independently halogen, alkyl, —OR₆, —N(R₆)₂, —SR₆, —SOR₆, —SO₂R₆, —CO₂R₆, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000;

w is an integer from 3-1000;

n is an integer from 1-5; and

Xaa₇ is Boc-protected tryptophan.

In some embodiments of any of the Formulas described herein, $[D]_v$ is -Leu₁-Thr₂. In other embodiments of the Formulas described herein, each E other than the third amino acid represented by E is an amino acid selected from Ala (alanine), D-Ala (D-alanine), Aib (α-aminoisobutyric acid), Sar (N-methyl glycine), and Ser (serine).

In some embodiments, w is an integer from 3-10, for example 3-6, 3-8, 6-8, or 6-10. In some embodiments, w is 3. In other embodiments, w is 6. In some embodiments, v is an integer from 1-10, for example 2-5. In some embodiments, v is 2.

In some embodiments, peptides disclosed herein bind a binding site defined at least in part by the MDMX amino acid side chains of L17, V46, M50, Y96 (forming the rim of the pocket) and L99. Without being bound by theory, binding to such a binding site improves one or more properties such as binding affinity, induction of apoptosis, in vitro or in vivo anti-tumor efficacy, or reduced ratio of binding affinities to MDMX versus MDM2.

In some embodiments, the peptidomimetic macrocycle has improved binding affinity to MDM2 or MDMX relative to a corresponding peptidomimetic macrocycle where w is 0, 1 or 2. In other instances, the peptidomimetic macrocycle has a reduced ratio of binding affinities to MDMX versus MDM2 relative to a corresponding peptidomimetic macrocycle where w is 0, 1 or 2. In still other instances, the peptidomimetic macrocycle has improved in vitro anti-tumor efficacy against p53 positive tumor cell lines relative to a corresponding peptidomimetic macrocycle where w is 0, 1 or 2. In some embodiments, the peptidomimetic macrocycle shows improved in vitro induction of apoptosis in p53 positive tumor cell lines relative to a corresponding peptidomimetic macrocycle where w is 0, 1 or 2. In other instances, the peptidomimetic macrocycle of claim 1, wherein the peptidomimetic macrocycle has an improved in vitro anti-tumor efficacy ratio for p53 positive versus p53 negative or mutant tumor cell lines relative to a corresponding peptidomimetic macrocycle where w is 0, 1 or 2. In some instances the improved efficacy ratio in vitro, is 1-29, ≥30-49, or ≥50. In still other instances, the peptidomimetic macrocycle has improved in vivo anti-tumor efficacy against p53 positive tumors relative to a corresponding peptidomimetic macrocycle where w is 0, 1 or 2. In some instances the improved efficacy ratio in vivo is 1-29, ≥30-49, or ≥50. In yet other instances, the peptidomimetic macrocycle has improved in vivo induction of apoptosis in p53 positive tumors relative to a corresponding peptidomimetic macrocycle where w is 0, 1 or 2. In some embodiments, the peptidomimetic macrocycle has improved cell permeability relative to a corresponding peptidomimetic macrocycle where w is 0, 1 or 2. In other cases, the peptidomimetic macrocycle has improved solubility relative to a corresponding peptidomimetic macrocycle where w is 0, 1 or 2.

In some embodiments, Xaa₅ is Glu or an amino acid analog thereof. In some embodiments, Xaa₅ is Glu or an amino acid analog thereof and wherein the peptidomimetic macrocycle has an improved property, such as improved binding affinity, improved solubility, improved cellular efficacy, improved cell permeability, improved in vivo or in vitro anti-tumor efficacy, or improved induction of apoptosis relative to a corresponding peptidomimetic macrocycle where Xaa₅ is Ala.

In some embodiments, the peptidomimetic macrocycle has improved binding affinity to MDM2 or MDMX relative to a corresponding peptidomimetic macrocycle where Xaa$_5$ is Ala. In other embodiments, the peptidomimetic macrocycle has a reduced ratio of binding affinities to MDMX vs MDM2 relative to a corresponding peptidomimetic macrocycle where Xaa$_5$ is Ala. In some embodiments, the peptidomimetic macrocycle has improved solubility relative to a corresponding peptidomimetic macrocycle where Xaa$_5$ is Ala, or the peptidomimetic macrocycle has improved cellular efficacy relative to a corresponding peptidomimetic macrocycle where Xaa$_5$ is Ala.

In some embodiments, Xaa$_5$ is Glu or an amino acid analog thereof and wherein the peptidomimetic macrocycle has improved biological activity, such as improved binding affinity, improved solubility, improved cellular efficacy, improved helicity, improved cell permeability, improved in vivo or in vitro anti-tumor efficacy, or improved induction of apoptosis relative to a corresponding peptidomimetic macrocycle where Xaa$_5$ is Ala.

In some embodiments, the peptidomimetic macrocycle has an activity against a p53+/+ cell line which is at least 2-fold, 3-fold, 5-fold, 10-fold, 20-fold, 30-fold, 50-fold, 70-fold, or 100-fold greater than its binding affinity against a p53-/- cell line. In some embodiments, the peptidomimetic macrocycle has an activity against a p53+/+ cell line which is between 1 and 29-fold, between 30 and 49-fold, or ≥50-fold greater than its binding affinity against a p53-/- cell line. Activity can be measured, for example, as an IC50 value. For example, the p53+/+ cell line is SJSA-1, RKO, HCT-116, or MCF-7 and the p53-/- cell line is RKO-E6 or SW-480. In some embodiments, the peptide has an IC50 against the p53+/+ cell line of less than 1 μM.

In some embodiments, Xaa$_5$ is Glu or an amino acid analog thereof and the peptidomimetic macrocycle has an activity against a p53+/+ cell line which is at least 10-fold greater than its binding affinity against a p53-/- cell line.

Additionally, a method is provided of treating cancer in a subject comprising administering to the subject a peptidomimetic macrocycle. In some embodiments, the cancer is head and neck cancer, melanoma, lung cancer, breast cancer, or glioma.

Also provided is a method of modulating the activity of p53 or MDM2 or MDMX in a subject comprising administering to the subject a peptidomimetic macrocycle, or a method of antagonizing the interaction between p53 and MDM2 and/or MDMX proteins in a subject comprising administering to the subject such a peptidomimetic macrocycle.

Provided herein is a method of preparing a composition comprising a peptidomimetic macrocycle of Formula (Ia):

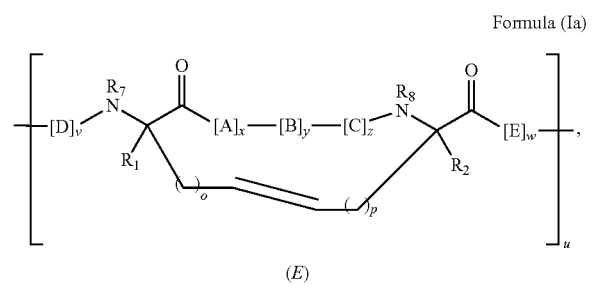

comprising an amino acid sequence which is about 60% to about 100% identical to an amino acid sequence selected from the group consisting of the amino acid sequences in Table 1, Table 1a, Table 1b, or Table 1c, the method comprising treating a compound of Formula (II)

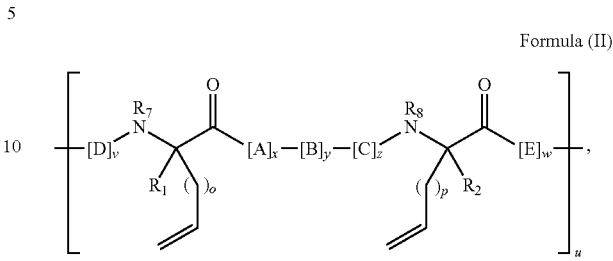

with a catalyst to result in the compound of Formula Ia
wherein in the compound(s) of Formulae (Ia) and (II)
each A, C, D, and E is independently an amino acid;
each B is independently an amino acid,

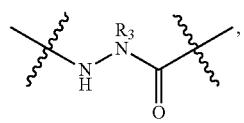

[—NH-L$_3$-CO—], [—NH-L$_3$-SO$_2$—], or [—NH-L$_3$-];

each R$_1$ and R$_2$ are independently hydrogen, alkyl, alkenyl, alkynyl, arylalkyl, cycloalkyl, cycloalkylalkyl, heteroalkyl, or heterocycloalkyl, unsubstituted or substituted with halogen; or at least one of R$_1$ and R$_2$ forms a macrocycle-forming linker L' connected to the alpha position of one of the D or E amino acids;

each R$_3$ is independently hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each L' is independently a macrocycle-forming linker of the formula -L$_1$-L$_2$-;

each L$_1$, L$_2$ and L$_3$ are independently alkylene, alkenylene, alkynylene, heteroalkylene, cycloalkylene, heterocycloalkylene, cycloarylene, heterocycloarylene, or [—R$_4$—K—R$_{4'}$—]$_n$, each being optionally substituted with R$_5$;

each R$_4$ and R$_{4'}$ is independently alkylene, alkenylene, alkynylene, heteroalkylene, cycloalkylene, heterocycloalkylene, arylene, or heteroarylene;

each K is independently O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently hydrogen, alkyl, alkenyl, alkynyl, arylalkyl, cycloalkylalkyl, heterocycloalkyl, a fluorescent moiety, a radioisotope or a therapeutic agent;

each R$_7$ is independently hydrogen, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

each R$_8$ is independently hydrogen, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

each v and w are independently integers from 1-1000;
u is an integer from 1-10;
each x, y and z are independently integers from 0-10;
each n is independently an integer from 1-5;
each o is independently an integer from 1 to 15;
each p is independently an integer from 1 to 15;
"(E)" indicates a trans double bond; and
one or more of the amino acids A, C and/or B when B is an amino acid, present in the compounds of Formulae (Ia) and (II), has a side chain bearing a protecting group.

In some embodiments, the protecting group is a nitrogen atom protecting group.

In some embodiments, the protecting group is a Boc group.

In some embodiments, the side chain of the amino acid bearing the protecting group comprises a protected indole.

In some embodiments, the amino acid bearing the protecting group on its side chain is tryptophan (W) that is protected by the protecting group on its indole nitrogen. For example, the protecting group is a Boc group.

In some embodiments, after the step of contacting the compound of Formula II with catalyst the compound of Formula (Ia) is obtained in equal or higher amounts than a corresponding compound which is a Z isomer. For example, after the step of contacting the compound of Formula II with catalyst the compound of Formula (Ia) is obtained in a 2, 3, 4, 5, 6, 7, 8, 9, or 10-fold higher amount than the corresponding compound which is a Z isomer.

In some embodiments, the catalyst is a ruthenium catalyst.

In some embodiments, the method further comprises the step of treating the compounds of Formula (Ia) with a reducing agent or an oxidizing agent.

In some embodiments, the compound of Formula (II) is attached to a solid support. In other embodiments, the compound of Formula (II) is not attached to a solid support.

In some embodiments, the method further comprises removing the protecting group(s) from the compounds of Formula (Ia).

In some embodiments, the ring closing metathesis is conducted at a temperature ranging from about 20° C. to about 80° C.

In some embodiments, the peptidomimetic macrocycle of Formula (Ia) has the Formula:

least one of $R_1$ and $R_2$ forms a macrocycle-forming linker L' connected to the alpha position of one of said D or E amino acids;

each L or L' is independently a macrocycle-forming linker of the formula -$L_1$-$L_2$-, wherein L comprises at least one double bond in the E configuration;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —N($R_6$)$_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000;
w is an integer from 3-1000;
n is an integer from 1-5; and $Xaa_7$ is Boc-protected tryptophan.

In some embodiments, the peptidomimetic macrocycle of Formula (Ia) comprises an α-helix.

INCORPORATION BY REFERENCE

All publications, patents, and patent applications mentioned in this specification are herein incorporated by reference to the same extent as if each individual publication,

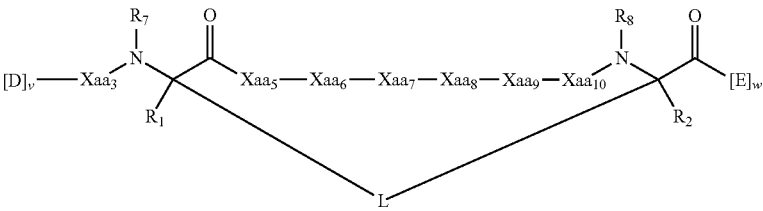

wherein:

each of $Xaa_3$, $Xaa_5$, $Xaa_6$, $Xaa_7$, $Xaa_8$, $Xaa_9$, and $Xaa_{10}$ is individually an amino acid, wherein at least two of $Xaa_3$, $Xaa_5$, $Xaa_6$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at patent, or patent application was specifically and individually indicated to be incorporated by reference.

BRIEF DESCRIPTION OF THE DRAWINGS

The novel features of the invention are set forth with particularity in the appended claims. A better understanding of the features and advantages of the present invention will be obtained by reference to the following detailed description that sets forth illustrative embodiments, in which the principles of the invention are utilized, and the accompanying drawings of which:

DETAILED DESCRIPTION OF THE INVENTION

Figure 1:
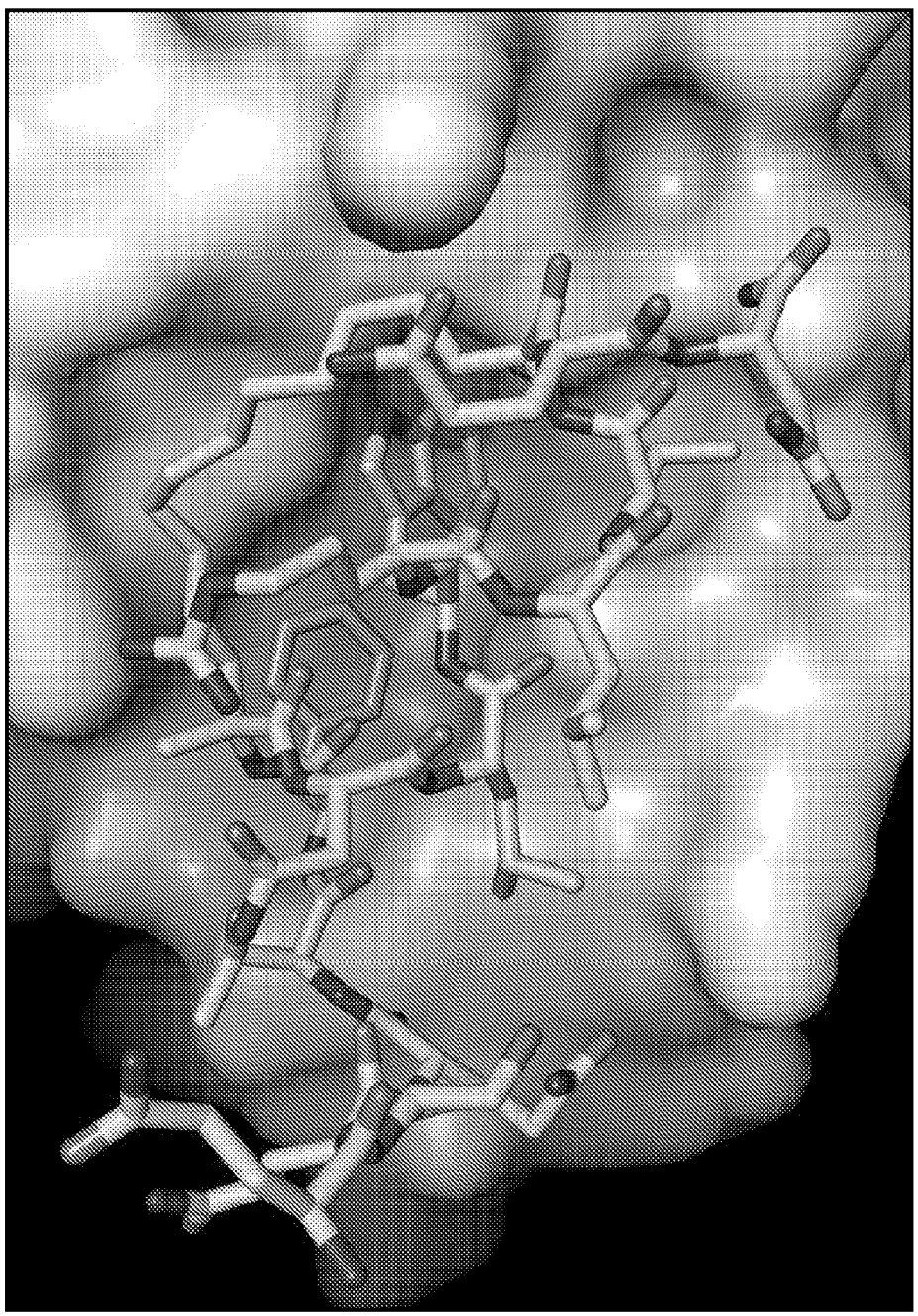
FIG. 1 shows a structure of peptidomimetic macrocycle 46 (Table 2b), a p53 peptidomimetic macrocycle, complexed with MDMX (Primary SwissProt accession no.: Q7ZUW7; Entry MDM4_DANRE).

As used herein, the term "macrocycle" refers to a molecule having a chemical structure including a ring or cycle formed by at least 9 covalently bonded atoms.

As used herein, the term "peptidomimetic macrocycle" or "crosslinked polypeptide" refers to a compound comprising a plurality of amino acid residues joined by a plurality of peptide bonds and at least one macrocycle-forming linker which forms a macrocycle between a first naturally-occurring or non-naturally-occurring amino acid residue (or analog) and a second naturally-occurring or non-naturally-occurring amino acid residue (or analog) within the same molecule. Peptidomimetic macrocycle include embodiments where the macrocycle-forming linker connects the α carbon of the first amino acid residue (or analog) to the α carbon of the second amino acid residue (or analog). The peptidomimetic macrocycles optionally include one or more non-peptide bonds between one or more amino acid residues and/or amino acid analog residues, and optionally include one or more non-naturally-occurring amino acid residues or amino acid analog residues in addition to any which form the macrocycle. A "corresponding uncrosslinked polypeptide" when referred to in the context of a peptidomimetic macrocycle is understood to relate to a polypeptide of the same length as the macrocycle and comprising the equivalent natural amino acids of the wild-type sequence corresponding to the macrocycle.

As used herein, the term "stability" refers to the maintenance of a defined secondary structure in solution by a peptidomimetic macrocycle as measured by circular dichroism, NMR or another biophysical measure, or resistance to proteolytic degradation in vitro or in vivo. Non-limiting examples of secondary structures contemplated herein are α-helices, $3_{10}$ helices, β-turns, and β-pleated sheets.

As used herein, the term "helical stability" refers to the maintenance of a helical structure by a peptidomimetic macrocycle as measured by circular dichroism or NMR. For example, in some embodiments, a peptidomimetic macrocycle exhibits at least a 1.25, 1.5, 1.75 or 2-fold increase in α-helicity as determined by circular dichroism compared to a corresponding uncrosslinked macrocycle.

The term "amino acid" refers to a molecule containing both an amino group and a carboxyl group. Suitable amino acids include, without limitation, both the D- and L-isomers of the naturally-occurring amino acids, as well as non-naturally occurring amino acids prepared by organic synthesis or other metabolic routes. The term amino acid, as used herein, includes, without limitation, α-amino acids, natural amino acids, non-natural amino acids, and amino acid analogs.

The term "α-amino acid" refers to a molecule containing both an amino group and a carboxyl group bound to a carbon which is designated the α-carbon.

The term "β-amino acid" refers to a molecule containing both an amino group and a carboxyl group in a β configuration.

The term "naturally occurring amino acid" refers to any one of the twenty amino acids commonly found in peptides synthesized in nature, and known by the one letter abbreviations A, R, N, C, D, Q, E, G, H, I, L, K, M, F, P, S, T, W, Y and V.

The following table shows a summary of the properties of natural amino acids:

| Amino Acid | 3-Letter Code | 1-Letter Code | Side-chain Polarity | Side-chain charge (pH 7.4) | Hydropathy Index |
|---|---|---|---|---|---|
| Alanine | Ala | A | nonpolar | neutral | 1.8 |
| Arginine | Arg | R | polar | positive | −4.5 |
| Asparagine | Asn | N | polar | neutral | −3.5 |
| Aspartic acid | Asp | D | polar | negative | −3.5 |
| Cysteine | Cys | C | polar | neutral | 2.5 |
| Glutamic acid | Glu | E | polar | negative | −3.5 |
| Glutamine | Gln | Q | polar | neutral | −3.5 |
| Glycine | Gly | G | nonpolar | neutral | −0.4 |
| Histidine | His | H | polar | positive(10%) neutral(90%) | −3.2 |
| Isoleucine | Ile | I | nonpolar | neutral | 4.5 |
| Leucine | Leu | L | nonpolar | neutral | 3.8 |
| Lysine | Lys | K | polar | positive | −3.9 |
| Methionine | Met | M | nonpolar | neutral | 1.9 |
| Phenylalanine | Phe | F | nonpolar | neutral | 2.8 |
| Proline | Pro | P | nonpolar | neutral | −1.6 |
| Serine | Ser | S | polar | neutral | −0.8 |
| Threonine | Thr | T | polar | neutral | −0.7 |
| Tryptophan | Trp | W | nonpolar | neutral | −0.9 |
| Tyrosine | Tyr | Y | polar | neutral | −1.3 |
| Valine | Val | V | nonpolar | neutral | 4.2 |

"Hydrophobic amino acids" include small hydrophobic amino acids and large hydrophobic amino acids. "Small hydrophobic amino acids" are glycine, alanine, proline, and analogs thereof "Large hydrophobic amino acids" are valine, leucine, isoleucine, phenylalanine, methionine, tryptophan, and analogs thereof "Polar amino acids" are serine, threonine, asparagine, glutamine, cysteine, tyrosine, and analogs thereof "Charged amino acids" are lysine, arginine, histidine, aspartate, glutamate, and analogs thereof.

The term "amino acid analog" refers to a molecule which is structurally similar to an amino acid and which can be substituted for an amino acid in the formation of a peptidomimetic macrocycle Amino acid analogs include, without limitation, β-amino acids and amino acids where the amino or carboxy group is substituted by a similarly reactive group (e.g., substitution of the primary amine with a secondary or tertiary amine, or substitution of the carboxy group with an ester).

The term "non-natural amino acid" refers to an amino acid which is not one of the twenty amino acids commonly found in peptides synthesized in nature, and known by the one letter abbreviations A, R, N, C, D, Q, E, G, H, I, L, K, M, F, P, S, T, W, Y and V. Non-natural amino acids or amino acid analogs include, without limitation, structures according to the following:
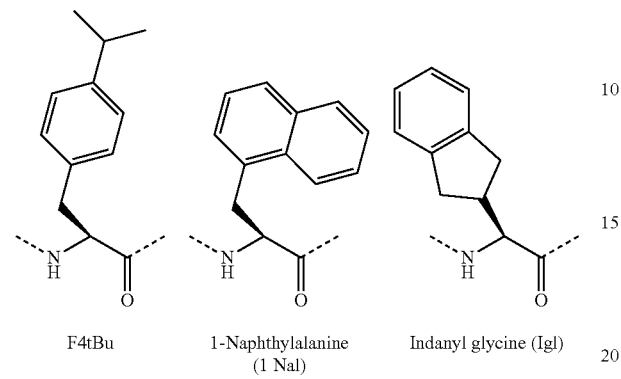
F4tBu     1-Naphthylalanine (1 Nal)     Indanyl glycine (Igl)
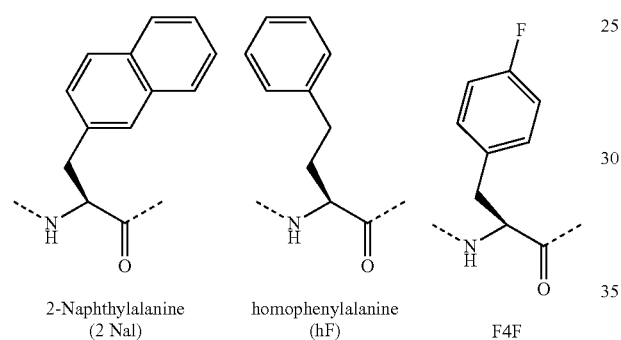
2-Naphthylalanine (2 Nal)     homophenylalanine (hF)     F4F
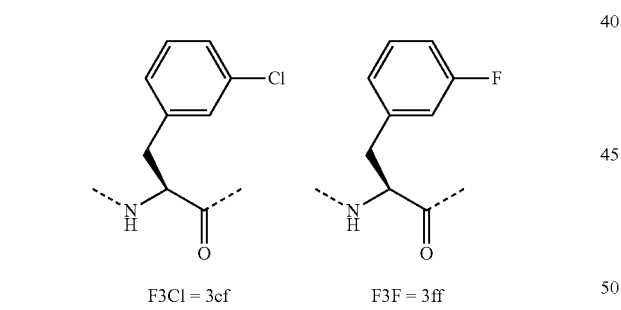
F3Cl = 3cf     F3F = 3ff
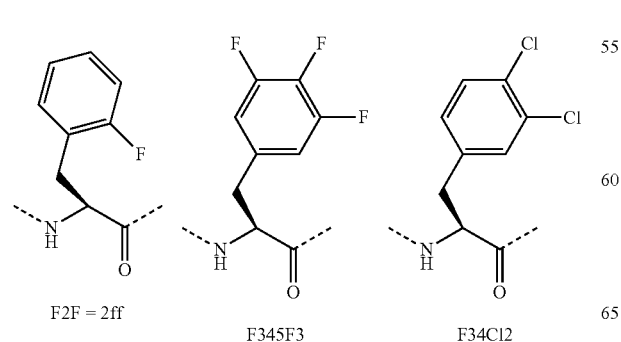
F2F = 2ff     F345F3     F34Cl2
-continued
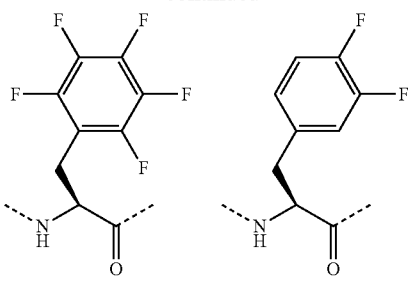
F5F     F34F2
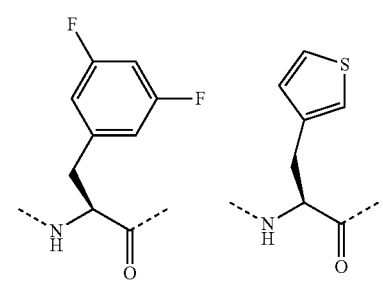
F35F2     2Thi
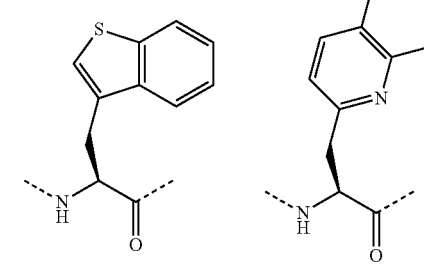
3BthA     2qA
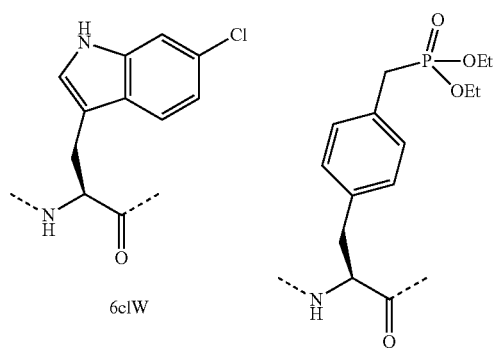
6clW     pmpEt
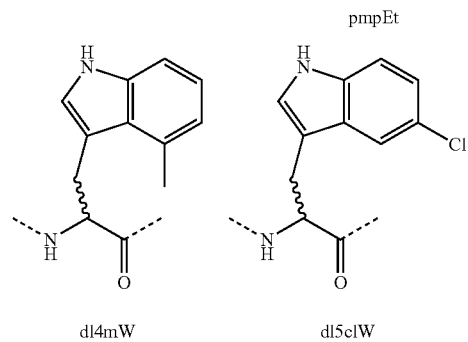
dl4mW     dl5clW

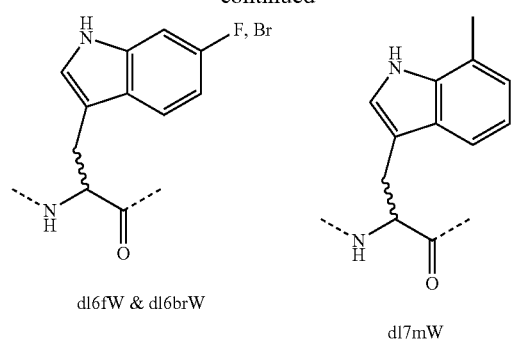
dl6fW & dl6brW    dl7mW
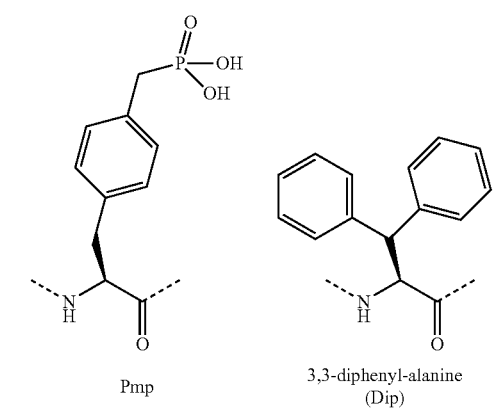
Pmp    3,3-diphenyl-alanine (Dip)
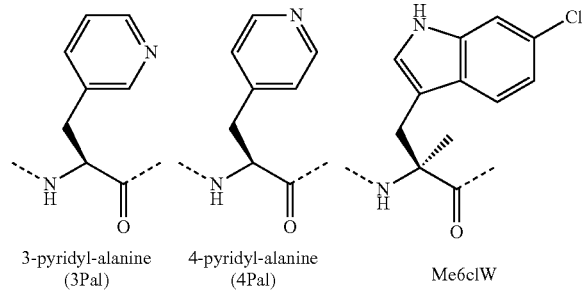
3-pyridyl-alanine (3Pal)    4-pyridyl-alanine (4Pal)    Me6clW
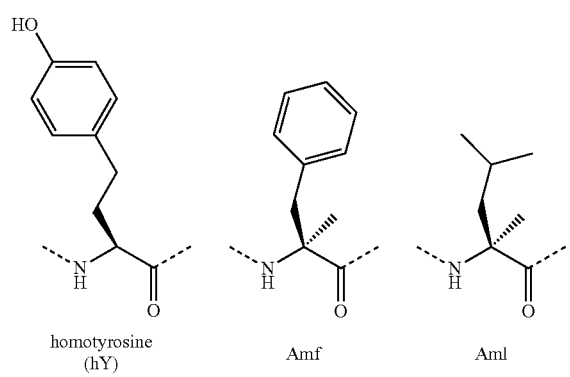
homotyrosine (hY)    Amf    Aml
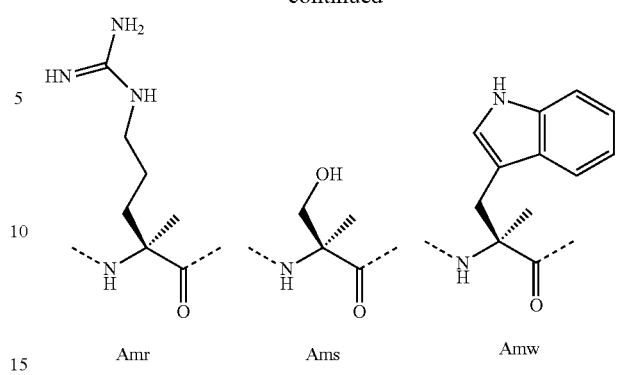
Amr    Ams    Amw
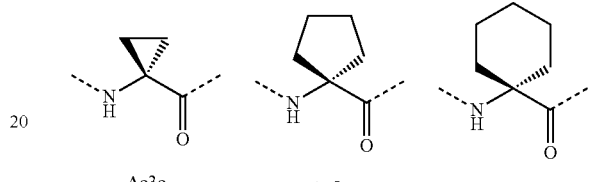
Ac3c    Ac5c    Ac6c
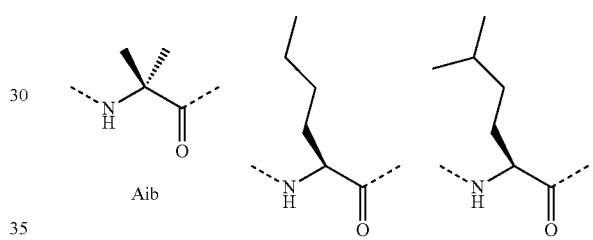
Aib    Norleucine (Nle)    Homoleucine (hL)
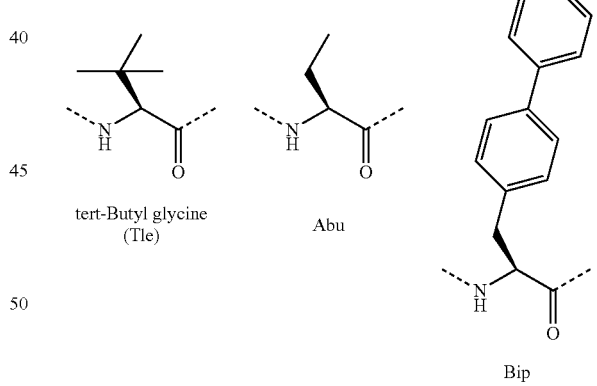
tert-Butyl glycine (Tle)    Abu    Bip
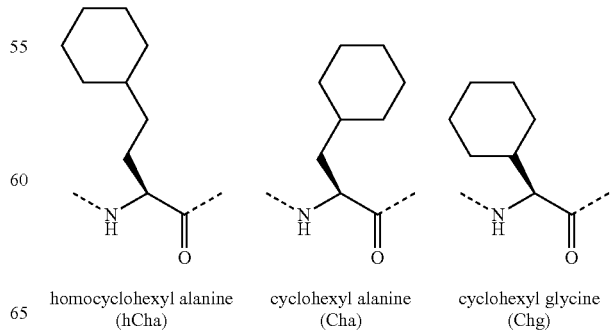
homocyclohexyl alanine (hCha)    cyclohexyl alanine (Cha)    cyclohexyl glycine (Chg)

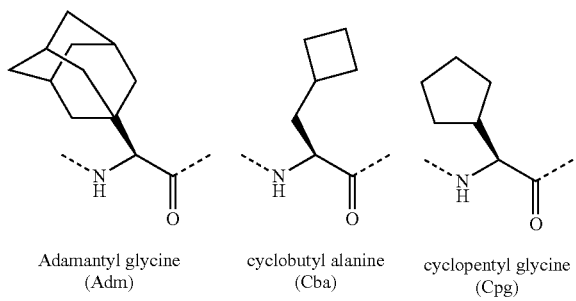
Adamantyl glycine (Adm)  cyclobutyl alanine (Cba)  cyclopentyl glycine (Cpg)
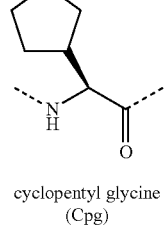
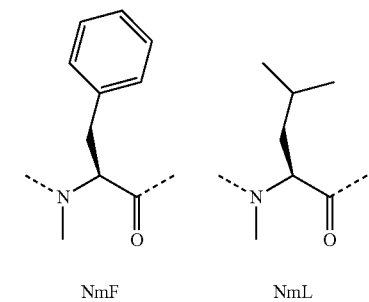
NmF  NmL  NmT
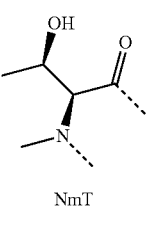
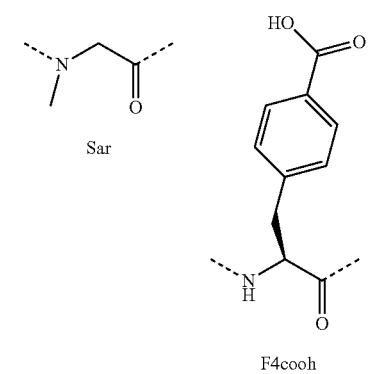
Sar  F4cooh  F2X
X = Cl, Br, CF3, CN, Me, NO2
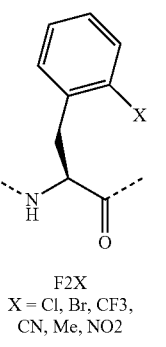
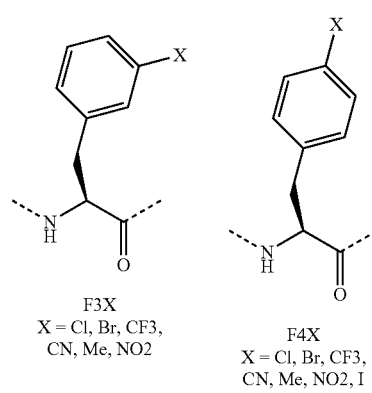
F3X
X = Cl, Br, CF3, CN, Me, NO2
F4X
X = Cl, Br, CF3, CN, Me, NO2, I
St//
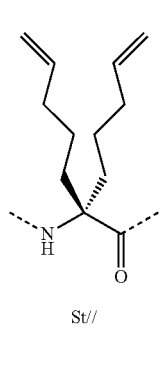
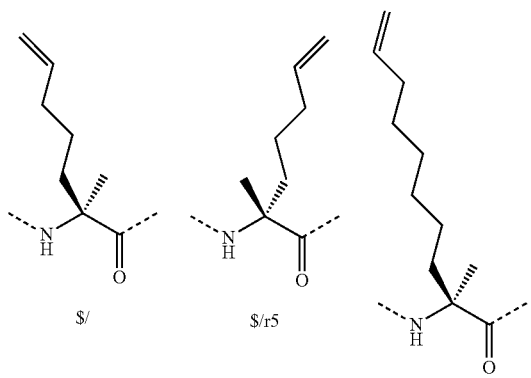
$/  $/r5  $/s8
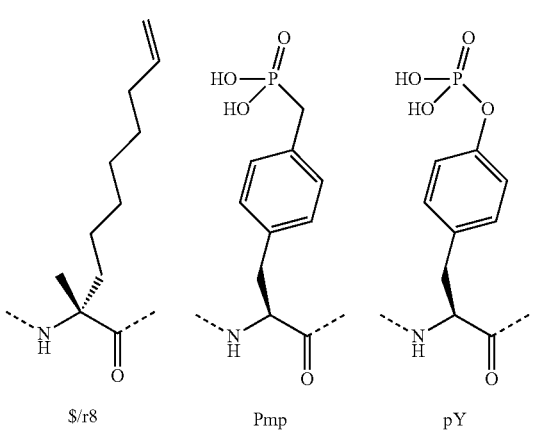
$/r8  Pmp  pY
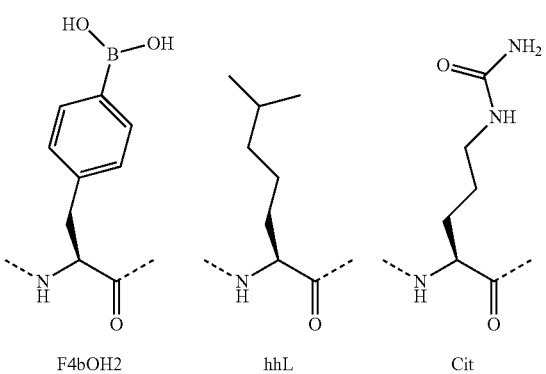
F4bOH2  hhL  Cit
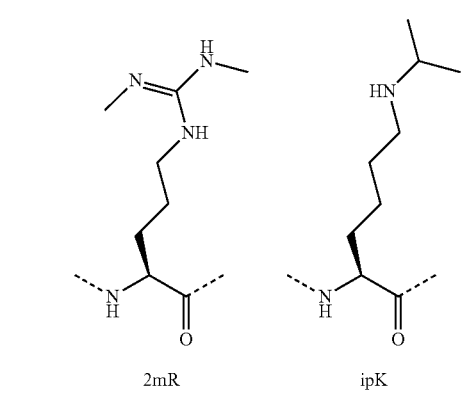
2mR  ipK

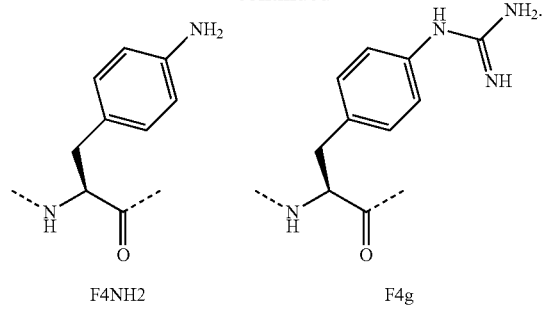

F4NH2    F4g

Amino acid analogs include β-amino acid analogs. Examples of β-amino acid analogs include, but are not limited to, the following: cyclic β-amino acid analogs; β-alanine; (R)-β-phenylalanine; (R)-1,2,3,4-tetrahydro-isoquinoline-3-acetic acid; (R)-3-amino-4-(1-naphthyl)-butyric acid; (R)-3-amino-4-(2,4-dichlorophenyl)butyric acid; (R)-3-amino-4-(2-chlorophenyl)-butyric acid; (R)-3-amino-4-(2-cyanophenyl)-butyric acid; (R)-3-amino-4-(2-fluorophenyl)-butyric acid; (R)-3-amino-4-(2-furyl)-butyric acid; (R)-3-amino-4-(2-methylphenyl)-butyric acid; (R)-3-amino-4-(2-naphthyl)-butyric acid; (R)-3-amino-4-(2-thienyl)-butyric acid; (R)-3-amino-4-(2-trifluoromethylphenyl)-butyric acid; (R)-3-amino-4-(3,4-dichlorophenyl)butyric acid; (R)-3-amino-4-(3,4-difluorophenyl)butyric acid; (R)-3-amino-4-(3-benzothienyl)-butyric acid; (R)-3-amino-4-(3-chlorophenyl)-butyric acid; (R)-3-amino-4-(3-cyanophenyl)-butyric acid; (R)-3-amino-4-(3-fluorophenyl)-butyric acid; (R)-3-amino-4-(3-methylphenyl)-butyric acid; (R)-3-amino-4-(3-pyridyl)-butyric acid; (R)-3-amino-4-(3-thienyl)-butyric acid; (R)-3-amino-4-(3-trifluoromethylphenyl)-butyric acid; (R)-3-amino-4-(4-bromophenyl)-butyric acid; (R)-3-amino-4-(4-chlorophenyl)-butyric acid; (R)-3-amino-4-(4-cyanophenyl)-butyric acid; (R)-3-amino-4-(4-fluorophenyl)-butyric acid; (R)-3-amino-4-(4-iodophenyl)-butyric acid; (R)-3-amino-4-(4-methylphenyl)-butyric acid; (R)-3-amino-4-(4-nitrophenyl)-butyric acid; (R)-3-amino-4-(4-pyridyl)-butyric acid; (R)-3-amino-4-(4-trifluoromethylphenyl)-butyric acid; (R)-3-amino-4-pentafluoro-phenylbutyric acid; (R)-3-amino-5-hexenoic acid; (R)-3-amino-5-hexynoic acid; (R)-3-amino-5-phenylpentanoic acid; (R)-3-amino-6-phenyl-5-hexenoic acid; (S)-1,2,3,4-tetrahydro-isoquinoline-3-acetic acid; (S)-3-amino-4-(1-naphthyl)-butyric acid; (S)-3-amino-4-(2,4-dichlorophenyl)butyric acid; (S)-3-amino-4-(2-chlorophenyl)-butyric acid; (S)-3-amino-4-(2-cyanophenyl)-butyric acid; (S)-3-amino-4-(2-fluorophenyl)-butyric acid; (S)-3-amino-4-(2-furyl)-butyric acid; (S)-3-amino-4-(2-methylphenyl)-butyric acid; (S)-3-amino-4-(2-naphthyl)-butyric acid; (S)-3-amino-4-(2-thienyl)-butyric acid; (S)-3-amino-4-(2-trifluoromethylphenyl)-butyric acid; (S)-3-amino-4-(3,4-dichlorophenyl)butyric acid; (S)-3-amino-4-(3,4-difluorophenyl)butyric acid; (S)-3-amino-4-(3-benzothienyl)-butyric acid; (S)-3-amino-4-(3-chlorophenyl)-butyric acid; (S)-3-amino-4-(3-cyanophenyl)-butyric acid; (S)-3-amino-4-(3-fluorophenyl)-butyric acid; (S)-3-amino-4-(3-methylphenyl)-butyric acid; (S)-3-amino-4-(3-pyridyl)-butyric acid; (S)-3-amino-4-(3-thienyl)-butyric acid; (S)-3-amino-4-(3-trifluoromethylphenyl)-butyric acid; (S)-3-amino-4-(4-bromophenyl)-butyric acid; (S)-3-amino-4-(4-chlorophenyl)-butyric acid; (S)-3-amino-4-(4-cyanophenyl)-butyric acid; (S)-3-amino-4-(4-fluorophenyl)-butyric acid; (S)-3-amino-4-(4-iodophenyl)-butyric acid; (S)-3-amino-4-(4-methylphenyl)-butyric acid; (S)-3-amino-4-(4-nitrophenyl)-butyric acid; (S)-3-amino-4-(4-pyridyl)-butyric acid; (S)-3-amino-4-(4-trifluoromethylphenyl)-butyric acid; (S)-3-amino-4-pentafluoro-phenylbutyric acid; (S)-3-amino-5-hexenoic acid; (S)-3-amino-5-hexynoic acid; (S)-3-amino-5-phenylpentanoic acid; (S)-3-amino-6-phenyl-5-hexenoic acid; 1,2,5,6-tetrahydropyridine-3-carboxylic acid; 1,2,5,6-tetrahydropyridine-4-carboxylic acid; 3-amino-3-(2-chlorophenyl)-propionic acid; 3-amino-3-(2-thienyl)-propionic acid; 3-amino-3-(3-bromophenyl)-propionic acid; 3-amino-3-(4-chlorophenyl)-propionic acid; 3-amino-3-(4-methoxyphenyl)-propionic acid; 3-amino-4,4,4-trifluoro-butyric acid; 3-aminoadipic acid; D-β-phenylalanine; β-leucine; L-β-homoalanine; L-β-homoaspartic acid γ-benzyl ester; L-β-homoglutamic acid δ-benzyl ester; L-β-homoisoleucine; L-β-homoleucine; L-β-homomethionine; L-β-homophenylalanine; L-β-homoproline; L-β-homotryptophan; L-β-homovaline; L-Nω-benzyloxycarbonyl-β-homolysine; Nω-L-β-homoarginine; O-benzyl-L-β-homohydroxyproline; O-benzyl-L-β-homoserine; O-benzyl-L-β-homothreonine; O-benzyl-L-β-homotyrosine; γ-trityl-L-β-homoasparagine; (R)-β-phenylalanine; L-β-homoaspartic acid γ-t-butyl ester; L-β-homoglutamic acid δ-t-butyl ester; L-Nω-β-homolysine; Nδ-trityl-L-β-homoglutamine; Nω-2,2,4,6,7-pentamethyl-dihydrobenzofuran-5-sulfonyl-L-β-homoarginine; O-t-butyl-L-β-homohydroxy-proline; O-t-butyl-L-β-homoserine; O-t-butyl-L-β-homothreonine; O-t-butyl-L-β-homotyrosine; 2-aminocyclopentane carboxylic acid; and 2-aminocyclohexane carboxylic acid.

Amino acid analogs include analogs of alanine, valine, glycine or leucine. Examples of amino acid analogs of alanine, valine, glycine, and leucine include, but are not limited to, the following: α-methoxyglycine; α-allyl-L-alanine; α-aminoisobutyric acid; α-methyl-leucine; β-(1-naphthyl)-D-alanine; β-(1-naphthyl)-L-alanine; β-(2-naphthyl)-D-alanine; β-(2-naphthyl)-L-alanine; β-(2-pyridyl)-D-alanine; β-(2-pyridyl)-L-alanine; β-(2-thienyl)-D-alanine; β-(2-thienyl)-L-alanine; β-(3-benzothienyl)-D-alanine; β-(3-benzothienyl)-L-alanine; β-(3-pyridyl)-D-alanine; β-(3-pyridyl)-L-alanine; β-(4-pyridyl)-D-alanine; β-(4-pyridyl)-L-alanine; β-chloro-L-alanine; β-cyano-L-alanin; β-cyclohexyl-D-alanine; β-cyclohexyl-L-alanine; β-cyclopenten-1-yl-alanine; β-cyclopentyl-alanine; β-cyclopropyl-L-Ala-OH-dicyclohexylammonium salt; β-t-butyl-D-alanine; β-t-butyl-L-alanine; γ-aminobutyric acid; L-α,β-diaminopropionic acid; 2,4-dinitro-phenylglycine; 2,5-dihydro-D-phenylglycine; 2-amino-4,4,4-trifluorobutyric acid; 2-fluoro-phenylglycine; 3-amino-4,4,4-trifluoro-butyric acid; 3-fluoro-valine; 4,4,4-trifluoro-valine; 4,5-dehydro-L-leu-OH-dicyclohexylammonium salt; 4-fluoro-D-phenylglycine; 4-fluoro-L-phenylglycine; 4-hydroxy-D-phenylglycine; 5,5,5-trifluoro-leucine; 6-aminohexanoic acid; cyclopentyl-D-Gly-OH-dicyclohexylammonium salt; cyclopentyl-Gly-OH.dicyclohexylammonium salt; D-α,β-diaminopropionic acid; D-α-aminobutyric acid; D-α-t-butylglycine; D-(2-thienyl)glycine; D-(3-thienyl)glycine; D-2-aminocaproic acid; D-2-indanylglycine; D-allylglycine.dicyclohexylammonium salt; D-cyclohexylglycine; D-norvaline; D-phenylglycine; β-aminobutyric acid; β-aminoisobutyric acid; (2-bromophenyl)glycine; (2-methoxyphenyl)glycine; (2-methylphenyl)glycine; (2-thiazoyl)glycine; (2-thienyl)glycine; 2-amino-3-(dimethylamino)-propionic acid; L-α,β-diaminopropionic acid; L-α-aminobutyric acid; L-α-t-butylglycine; L-(3-thienyl)glycine; L-2-amino-3-(dimethylamino)-propionic acid; L-2-aminocaproic acid dicyclohexylammonium salt; L-2-indanylglycine; L-allylglycine.dicyclohexyl ammonium salt; L-cyclohexylglycine; L-phenylglycine; L-propargylglycine;

L-norvaline; N-α-aminomethyl-L-alanine; D-α,γ-diaminobutyric acid; L-α,γ-diaminobutyric acid; β-cyclopropyl-L-alanine; (N-β-(2,4-dinitrophenyl))-L-α,β-diaminopropionic acid; (N-β-1-(4,4-dimethyl-2,6-dioxocyclohex-1-ylidene)ethyl)-D-α,β-diaminopropionic acid; (N-β-1-(4,4-dimethyl-2,6-dioxocyclohex-1-ylidene)ethyl)-L-α,β-diaminopropionic acid; (N-β-4-methyltrityl)-L-α,β-diaminopropionic acid; (N-β-allyloxycarbonyl)-L-α,β-diaminopropionic acid; (N-γ-1-(4,4-dimethyl-2,6-dioxocyclohex-1-ylidene)ethyl)-D-α,γ-diaminobutyric acid; (N-γ-1-(4,4-dimethyl-2,6-dioxocyclohex-1-ylidene)ethyl)-L-α,γ-diaminobutyric acid; (N-γ-4-methyltrityl)-D-α,γ-diaminobutyric acid; (N-γ-4-methyltrityl)-L-α,γ-diaminobutyric acid; (N-γ-allyloxycarbonyl)-L-α,γ-diaminobutyric acid; D-α,γ-diaminobutyric acid; 4,5-dehydro-L-leucine; cyclopentyl-D-Gly-OH; cyclopentyl-Gly-OH; D-allylglycine; D-homocyclohexylalanine; L-1-pyrenylalanine; L-2-aminocaproic acid; L-allylglycine; L-homocyclohexylalanine; and N-(2-hydroxy-4-methoxy-Bzl)-Gly-OH.

Amino acid analogs include analogs of arginine or lysine. Examples of amino acid analogs of arginine and lysine include, but are not limited to, the following: citrulline; L-2-amino-3-guanidinopropionic acid; L-2-amino-3-ureidopropionic acid; L-citrulline; Lys(Me)₂-OH; Lys(N₃)-OH; Nδ-benzyloxycarbonyl-L-ornithine; Nω-nitro-D-arginine; Nω-nitro-L-arginine; α-methyl-ornithine; 2,6-diaminoheptanedioic acid; L-ornithine; (Nδ-1-(4,4-dimethyl-2,6-dioxocyclohex-1-ylidene)ethyl)-D-ornithine; (Nδ-1-(4,4-dimethyl-2,6-dioxo-cyclohex-1-ylidene)ethyl)-L-ornithine; (Nδ-4-methyltrityl)-D-ornithine; (Nδ-4-methyltrityl)-L-ornithine; D-ornithine; L-ornithine; Arg(Me)(Pbf)-OH; Arg(Me)₂-OH (asymmetrical); Arg(Me)2-OH (symmetrical); Lys(ivDde)-OH; Lys(Me)2-OH.HCl; Lys(Me3)-OH chloride; Nω-nitro-D-arginine; and Nω-nitro-L-arginine.

Amino acid analogs include analogs of aspartic or glutamic acids. Examples of amino acid analogs of aspartic and glutamic acids include, but are not limited to, the following: α-methyl-D-aspartic acid; α-methyl-glutamic acid; α-methyl-L-aspartic acid; γ-methylene-glutamic acid; (N-γ-ethyl)-L-glutamine; [N-α-(4-aminobenzoyl)]-L-glutamic acid; 2,6-diaminopimelic acid; L-α-aminosuberic acid; D-2-aminoadipic acid; D-α-aminosuberic acid; α-aminopimelic acid; iminodiacetic acid; L-2-aminoadipic acid; threo-β-methyl-aspartic acid; γ-carboxy-D-glutamic acid γ,γ-di-t-butyl ester; γ-carboxy-L-glutamic acid γ,γ-di-t-butyl ester; Glu(OAll)-OH; L-Asu(OtBu)-OH; and pyroglutamic acid.

Amino acid analogs include analogs of cysteine and methionine. Examples of amino acid analogs of cysteine and methionine include, but are not limited to, Cys(farnesyl)-OH, Cys(farnesyl)-OMe, α-methyl-methionine, Cys(2-hydroxyethyl)-OH, Cys(3-aminopropyl)-OH, 2-amino-4-(ethylthio)butyric acid, buthionine, buthioninesulfoximine, ethionine, methionine methylsulfonium chloride, selenomethionine, cysteic acid, [2-(4-pyridyl)ethyl]-DL-penicillamine, [2-(4-pyridyl)ethyl]-L-cysteine, 4-methoxybenzyl-D-penicillamine, 4-methoxybenzyl-L-penicillamine, 4-methylbenzyl-D-penicillamine, 4-methylbenzyl-L-penicillamine, benzyl-D-cysteine, benzyl-L-cysteine, benzyl-DL-homocysteine, carbamoyl-L-cysteine, carboxyethyl-L-cysteine, carboxymethyl-L-cysteine, diphenylmethyl-L-cysteine, ethyl-L-cysteine, methyl-L-cysteine, t-butyl-D-cysteine, trityl-L-homocysteine, trityl-D-penicillamine, cystathionine, homocystine, L-homocystine, (2-aminoethyl)-L-cysteine, seleno-L-cysteine, cystathionine, Cys(StBu)-OH, and acetamidomethyl-D-penicillamine.

Amino acid analogs include analogs of phenylalanine and tyrosine. Examples of amino acid analogs of phenylalanine and tyrosine include β-methyl-phenylalanine, β-hydroxy-phenylalanine, α-methyl-3-methoxy-DL-phenylalanine, α-methyl-D-phenylalanine, α-methyl-L-phenylalanine, 1,2,3,4-tetrahydroisoquinoline-3-carboxylic acid, 2,4-dichloro-phenylalanine, 2-(trifluoromethyl)-D-phenylalanine, 2-(trifluoromethyl)-L-phenylalanine, 2-bromo-D-phenylalanine, 2-bromo-L-phenylalanine, 2-chloro-D-phenylalanine, 2-chloro-L-phenylalanine, 2-cyano-D-phenylalanine, 2-cyano-L-phenylalanine, 2-fluoro-D-phenylalanine, 2-fluoro-L-phenylalanine, 2-methyl-D-phenylalanine, 2-methyl-L-phenylalanine, 2-nitro-D-phenylalanine, 2-nitro-L-phenylalanine, 2; 4; 5-trihydroxy-phenylalanine, 3,4,5-trifluoro-D-phenylalanine, 3,4,5-trifluoro-L-phenylalanine, 3,4-dichloro-D-phenylalanine, 3,4-dichloro-L-phenylalanine, 3,4-difluoro-D-phenylalanine, 3,4-difluoro-L-phenylalanine, 3,4-dihydroxy-L-phenylalanine, 3,4-dimethoxy-L-phenylalanine, 3,5,3'-triiodo-L-thyronine, 3,5-diiodo-D-tyrosine, 3,5-diiodo-L-tyrosine, 3,5-diiodo-L-thyronine, 3-(trifluoromethyl)-D-phenylalanine, 3-(trifluoromethyl)-L-phenylalanine, 3-amino-L-tyrosine, 3-bromo-D-phenylalanine, 3-bromo-L-phenylalanine, 3-chloro-D-phenylalanine, 3-chloro-L-phenylalanine, 3-chloro-L-tyrosine, 3-cyano-D-phenylalanine, 3-cyano-L-phenylalanine, 3-fluoro-D-phenylalanine, 3-fluoro-L-phenylalanine, 3-fluoro-tyrosine, 3-iodo-D-phenylalanine, 3-iodo-L-phenylalanine, 3-iodo-L-tyrosine, 3-methoxy-L-tyrosine, 3-methyl-D-phenylalanine, 3-methyl-L-phenylalanine, 3-nitro-D-phenylalanine, 3-nitro-L-phenylalanine, 3-nitro-L-tyrosine, 4-(trifluoromethyl)-D-phenylalanine, 4-(trifluoromethyl)-L-phenylalanine, 4-amino-D-phenylalanine, 4-amino-L-phenylalanine, 4-benzoyl-D-phenylalanine, 4-benzoyl-L-phenylalanine, 4-bis(2-chloroethyl)amino-L-phenylalanine, 4-bromo-D-phenylalanine, 4-bromo-L-phenylalanine, 4-chloro-D-phenylalanine, 4-chloro-L-phenylalanine, 4-cyano-D-phenylalanine, 4-cyano-L-phenylalanine, 4-fluoro-D-phenylalanine, 4-fluoro-L-phenylalanine, 4-iodo-D-phenylalanine, 4-iodo-L-phenylalanine, homophenylalanine, thyroxine, 3,3-diphenylalanine, thyronine, ethyl-tyrosine, and methyl-tyrosine.

Amino acid analogs include analogs of proline. Examples of amino acid analogs of proline include, but are not limited to, 3,4-dehydro-proline, 4-fluoro-proline, cis-4-hydroxyproline, thiazolidine-2-carboxylic acid, and trans-4-fluoro-proline.

Amino acid analogs include analogs of serine and threonine. Examples of amino acid analogs of serine and threonine include, but are not limited to, 3-amino-2-hydroxy-5-methylhexanoic acid, 2-amino-3-hydroxy-4-methylpentanoic acid, 2-amino-3-ethoxybutanoic acid, 2-amino-3-methoxybutanoic acid, 4-amino-3-hydroxy-6-methylheptanoic acid, 2-amino-3-benzyloxypropionic acid, 2-amino-3-benzyloxypropionic acid, 2-amino-3-ethoxypropionic acid, 4-amino-3-hydroxybutanoic acid, and α-methylserine.

Amino acid analogs include analogs of tryptophan. Examples of amino acid analogs of tryptophan include, but are not limited to, the following: α-methyl-tryptophan; β-(3-benzothienyl)-D-alanine; β-(3-benzothienyl)-L-alanine; 1-methyl-tryptophan; 4-methyl-tryptophan; 5-benzyloxy-tryptophan; 5-bromo-tryptophan; 5-chloro-tryptophan; 5-fluoro-tryptophan; 5-hydroxy-tryptophan; 5-hydroxy-L-tryptophan; 5-methoxy-tryptophan; 5-methoxy-L-tryptophan; 5-methyl-tryptophan; 6-bromo-tryptophan; 6-chloro-D-tryptophan; 6-chloro-tryptophan; 6-fluoro-tryptophan; 6-methyl-tryptophan; 7-benzyloxy-tryptophan; 7-bromo-tryptophan; 7-methyl-tryptophan; D-1,2,3,4-tetrahydro-norharman-3-carboxylic acid; 6-methoxy-1,2,3,4-tetrahydronorharman-1-carboxylic acid; 7-azatryptophan; L-1,2,3,4-tetrahydro-norharman-3-carboxylic acid; 5-methoxy-2-methyl-tryptophan; and 6-chloro-L-tryptophan.

In some embodiments, amino acid analogs are racemic. In some embodiments, the D isomer of the amino acid analog is used. In some embodiments, the L isomer of the amino acid analog is used. In other embodiments, the amino acid analog comprises chiral centers that are in the R or S configuration. In still other embodiments, the amino group (s) of a β-amino acid analog is substituted with a protecting group, e.g., tert-butyloxycarbonyl (BOC group), 9-fluorenylmethyloxycarbonyl (FMOC), tosyl, and the like. In yet other embodiments, the carboxylic acid functional group of a β-amino acid analog is protected, e.g., as its ester derivative. In some embodiments the salt of the amino acid analog is used.

A "non-essential" amino acid residue is a residue that can be altered from the wild-type sequence of a polypeptide without abolishing or substantially altering its essential biological or biochemical activity (e.g., receptor binding or activation). An "essential" amino acid residue is a residue that, when altered from the wild-type sequence of the polypeptide, results in abolishing or substantially abolishing the polypeptide's essential biological or biochemical activity.

A "conservative amino acid substitution" is one in which the amino acid residue is replaced with an amino acid residue having a similar side chain. Families of amino acid residues having similar side chains have been defined in the art. These families include amino acids with basic side chains (e.g., K, R, H), acidic side chains (e.g., D, E), uncharged polar side chains (e.g., G, N, Q, S, T, Y, C), nonpolar side chains (e.g., A, V, L, I, P, F, M, W), beta-branched side chains (e.g., T, V, I) and aromatic side chains (e.g., Y, F, W, H). Thus, a predicted nonessential amino acid residue in a polypeptide, for example, is replaced with another amino acid residue from the same side chain family. Other examples of acceptable substitutions are substitutions based on isosteric considerations (e.g. norleucine for methionine) or other properties (e.g. 2-thienylalanine for phenylalanine, or 6-Cl-tryptophan for tryptophan).

The term "capping group" refers to the chemical moiety occurring at either the carboxy or amino terminus of the polypeptide chain of the subject peptidomimetic macrocycle. The capping group of a carboxy terminus includes an unmodified carboxylic acid (i.e. —COOH) or a carboxylic acid with a substituent. For example, the carboxy terminus can be substituted with an amino group to yield a carboxamide at the C-terminus Various substituents include but are not limited to primary and secondary amines, including pegylated secondary amines Representative secondary amine capping groups for the C-terminus include:

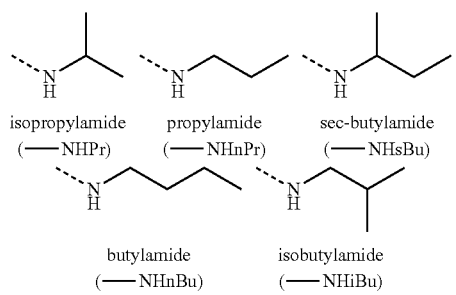

isopropylamide (—NHPr)   propylamide (—NHnPr)   sec-butylamide (—NHsBu)

butylamide (—NHnBu)   isobutylamide (—NHiBu)

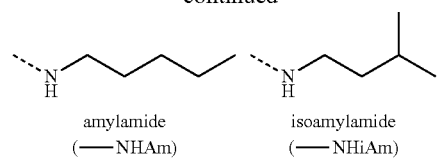

amylamide (—NHAm)   isoamylamide (—NHiAm)

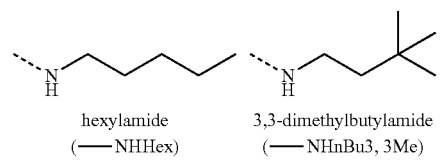

hexylamide (—NHHex)   3,3-dimethylbutylamide (—NHnBu3,3Me)

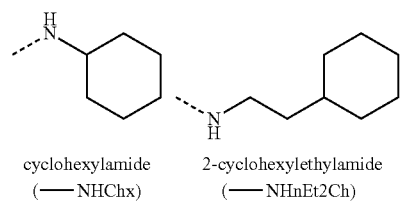

cyclohexylamide (—NHChx)   2-cyclohexylethylamide (—NHnEt2Ch)

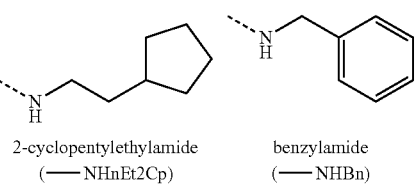

2-cyclopentylethylamide (—NHnEt2Cp)   benzylamide (—NHBn)

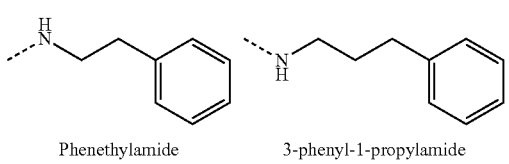

Phenethylamide (NHPe)   3-phenyl-1-propylamide (—NHnPr3Ph)

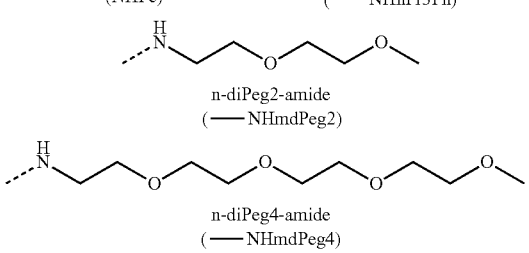

n-diPeg2-amide (—NHmdPeg2)

n-diPeg4-amide (—NHmdPeg4)

The capping group of an amino terminus includes an unmodified amine (i.e. —NH$_2$) or an amine with a substituent. For example, the amino terminus can be substituted with an acyl group to yield a carboxamide at the N-terminus. Various substituents include but are not limited to substituted acyl groups, including C$_1$-C$_6$ carbonyls, C$_7$-C$_{30}$ carbonyls, and pegylated carbamates. Representative capping groups for the N-terminus include, but are not limited to, 4-FBzl (4-fluoro-benzyl) and the following:

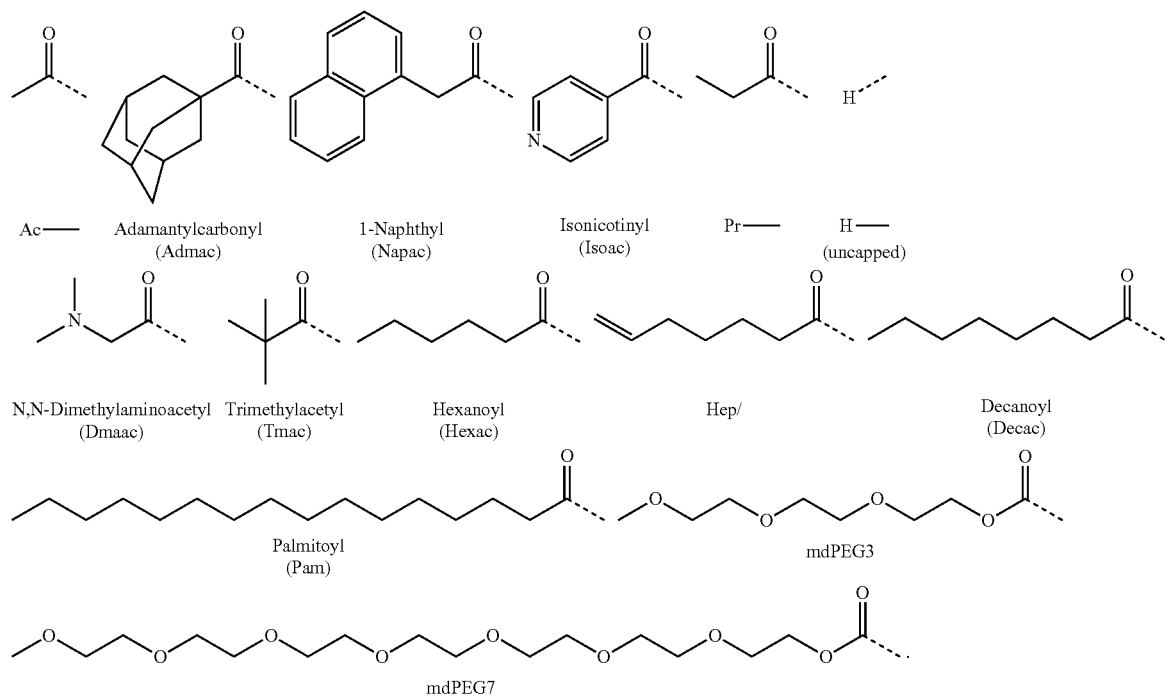

The term "member" as used herein in conjunction with macrocycles or macrocycle-forming linkers refers to the atoms that form or can form the macrocycle, and excludes substituent or side chain atoms. By analogy, cyclodecane, 1,2-difluoro-decane and 1,3-dimethyl cyclodecane are all considered ten-membered macrocycles as the hydrogen or fluoro substituents or methyl side chains do not participate in forming the macrocycle.

The symbol "⫽" when used as part of a molecular structure refers to a single bond or a trans or cis double bond.

The term "amino acid side chain" refers to a moiety attached to the α-carbon (or another backbone atom) in an amino acid. For example, the amino acid side chain for alanine is methyl, the amino acid side chain for phenylalanine is phenylmethyl, the amino acid side chain for cysteine is thiomethyl, the amino acid side chain for aspartate is carboxymethyl, the amino acid side chain for tyrosine is 4-hydroxyphenylmethyl, etc. Other non-naturally occurring amino acid side chains are also included, for example, those that occur in nature (e.g., an amino acid metabolite) or those that are made synthetically (e.g., an α,α di-substituted amino acid).

The term "α,α di-substituted amino" acid refers to a molecule or moiety containing both an amino group and a carboxyl group bound to a carbon (the α-carbon) that is attached to two natural or non-natural amino acid side chains.

The term "polypeptide" encompasses two or more naturally or non-naturally-occurring amino acids joined by a covalent bond (e.g., an amide bond). Polypeptides as described herein include full length proteins (e.g., fully processed proteins) as well as shorter amino acid sequences (e.g., fragments of naturally-occurring proteins or synthetic polypeptide fragments).

The term "first C-terminal amino acid" refers to the amino acid which is closest to the C-terminus. The term "second C-terminal amino acid" refers to the amino acid attached at the N-terminus of the first C-terminal amino acid.

The term "macrocyclization reagent" or "macrocycle-forming reagent" as used herein refers to any reagent which can be used to prepare a peptidomimetic macrocycle by mediating the reaction between two reactive groups. Reactive groups can be, for example, an azide and alkyne, in which case macrocyclization reagents include, without limitation, Cu reagents such as reagents which provide a reactive Cu(I) species, such as CuBr, CuI or CuOTf, as well as Cu(II) salts such as Cu(CO$_2$CH$_3$)$_2$, CuSO$_4$, and CuCl$_2$ that can be converted in situ to an active Cu(I) reagent by the addition of a reducing agent such as ascorbic acid or sodium ascorbate. Macrocyclization reagents can additionally include, for example, Ru reagents known in the art such as Cp*RuCl (PPh$_3$)$_2$, [Cp*RuCl]$_4$ or other Ru reagents which can provide a reactive Ru(II) species. In other cases, the reactive groups are terminal olefins. In such embodiments, the macrocyclization reagents or macrocycle-forming reagents are metathesis catalysts including, but not limited to, stabilized, late transition metal carbene complex catalysts such as Group VIII transition metal carbene catalysts. For example, such catalysts are Ru and Os metal centers having a +2 oxidation state, an electron count of 16 and pentacoordinated. In other examples, catalysts have W or Mo centers. Various catalysts are disclosed in Grubbs et al., "Ring Closing Metathesis and Related Processes in Organic Synthesis" Acc. Chem. Res. 1995, 28, 446-452; U.S. Pat. No. 5,811,515; U.S. Pat. No. 7,932,397; U.S. Application No. 2011/0065915; U.S. Application No. 2011/0245477; Yu et al., "Synthesis of Macrocyclic Natural Products by Catalyst-Controlled Stereoselective Ring-Closing Metathesis," Nature 2011, 479, 88; and Peryshkov et al., "Z-Selective Olefin Metathesis Reactions Promoted by Tungsten Oxo Alkylidene Complexes," J. Am. Chem. Soc. 2011, 133, 20754. In yet other cases, the reactive groups are thiol groups. In such embodiments, the macrocyclization reagent is, for example, a linker functionalized with two thiol-reactive groups such as halogen groups.

The term "halo" or "halogen" refers to fluorine, chlorine, bromine or iodine or a radical thereof.

The term "alkyl" refers to a hydrocarbon chain that is a straight chain or branched chain, containing the indicated number of carbon atoms. For example, $C_1$-$C_{10}$ indicates that the group has from 1 to 10 (inclusive) carbon atoms in it. In the absence of any numerical designation, "alkyl" is a chain (straight or branched) having 1 to 20 (inclusive) carbon atoms in it.

The term "alkylene" refers to a divalent alkyl (i.e., —R—).

The term "alkenyl" refers to a hydrocarbon chain that is a straight chain or branched chain having one or more carbon-carbon double bonds. The alkenyl moiety contains the indicated number of carbon atoms. For example, $C_2$-$C_{10}$ indicates that the group has from 2 to 10 (inclusive) carbon atoms in it. The term "lower alkenyl" refers to a $C_2$-$C_6$ alkenyl chain. In the absence of any numerical designation, "alkenyl" is a chain (straight or branched) having 2 to 20 (inclusive) carbon atoms in it.

The term "alkynyl" refers to a hydrocarbon chain that is a straight chain or branched chain having one or more carbon-carbon triple bonds. The alkynyl moiety contains the indicated number of carbon atoms. For example, $C_2$-$C_{10}$ indicates that the group has from 2 to 10 (inclusive) carbon atoms in it. The term "lower alkynyl" refers to a $C_2$-$C_6$ alkynyl chain. In the absence of any numerical designation, "alkynyl" is a chain (straight or branched) having 2 to 20 (inclusive) carbon atoms in it.

The term "aryl" refers to a 6-carbon monocyclic or 10-carbon bicyclic aromatic ring system wherein 0, 1, 2, 3, or 4 atoms of each ring are substituted by a substituent. Examples of aryl groups include phenyl, naphthyl and the like. The term "arylalkoxy" refers to an alkoxy substituted with aryl.

"Arylalkyl" refers to an aryl group, as defined above, wherein one of the aryl group's hydrogen atoms has been replaced with a $C_1$-$C_5$ alkyl group, as defined above. Representative examples of an arylalkyl group include, but are not limited to, 2-methylphenyl, 3-methylphenyl, 4-methylphenyl, 2-ethylphenyl, 3-ethylphenyl, 4-ethylphenyl, 2-propylphenyl, 3-propylphenyl, 4-propylphenyl, 2-butylphenyl, 3-butylphenyl, 4-butylphenyl, 2-pentylphenyl, 3-pentylphenyl, 4-pentylphenyl, 2-isopropylphenyl, 3-isopropylphenyl, 4-isopropylphenyl, 2-isobutylphenyl, 3-isobutylphenyl, 4-isobutylphenyl, 2-sec-butylphenyl, 3-sec-butylphenyl, 4-sec-butylphenyl, 2-t-butylphenyl, 3-t-butylphenyl and 4-t-butylphenyl.

"Arylamido" refers to an aryl group, as defined above, wherein one of the aryl group's hydrogen atoms has been replaced with one or more —C(O)NH$_2$ groups. Representative examples of an arylamido group include 2-C(O)NH2-phenyl, 3-C(O)NH$_2$-phenyl, 4-C(O)NH$_2$-phenyl, 2-C(O)NH$_2$-pyridyl, 3-C(O)NH$_2$-pyridyl, and 4-C(O)NH$_2$-pyridyl, "Alkylheterocycle" refers to a $C_1$-$C_5$ alkyl group, as defined above, wherein one of the $C_1$-$C_5$ alkyl group's hydrogen atoms has been replaced with a heterocycle. Representative examples of an alkylheterocycle group include, but are not limited to, —CH$_2$CH$_2$-morpholine, —CH$_2$CH$_2$-piperidine, —CH$_2$CH$_2$CH$_2$-morpholine, and —CH$_2$CH$_2$-imidazole.

"Alkylamido" refers to a $C_1$-$C_5$ alkyl group, as defined above, wherein one of the $C_1$-$C_5$ alkyl group's hydrogen atoms has been replaced with a —C(O)NH$_2$ group. Representative examples of an alkylamido group include, but are not limited to, —CH$_2$—C(O)NH$_2$, —CH$_2$CH$_2$—C(O)NH$_2$, —CH$_2$CH$_2$CH$_2$C(O)NH$_2$, —CH$_2$CH$_2$CH$_2$CH$_2$C(O)NH$_2$, —CH$_2$CH$_2$CH$_2$CH$_2$CH$_2$C(O)NH$_2$, —CH$_2$CH(C(O)NH$_2$)CH$_3$, —CH$_2$CH(C(O)NH$_2$)CH$_2$CH$_3$, —CH(C(O)NH$_2$)CH$_2$CH$_3$, —C(CH$_3$)$_2$CH$_2$C(O)NH$_2$, —CH$_2$—CH$_2$—NH—C(O)—CH$_3$, —CH$_2$—CH$_2$—NH—C(O)—CH$_3$—CH3, and —CH$_2$—CH$_2$—NH—C(O)—CH=CH$_2$.

"Alkanol" refers to a $C_1$-$C_5$ alkyl group, as defined above, wherein one of the $C_1$-$C_5$ alkyl group's hydrogen atoms has been replaced with a hydroxyl group. Representative examples of an alkanol group include, but are not limited to, —CH$_2$OH, —CH$_2$CH$_2$OH, —CH$_2$CH$_2$CH$_2$OH, —CH$_2$CH$_2$CH$_2$CH$_2$OH, —CH$_2$CH$_2$CH$_2$CH$_2$CH$_2$OH, —CH$_2$CH(OH)CH$_3$, —CH$_2$CH(OH)CH$_2$CH$_3$, —CH(OH)CH$_3$ and —C(CH$_3$)$_2$CH$_2$OH.

"Alkylcarboxy" refers to a $C_1$-$C_5$ alkyl group, as defined above, wherein one of the $C_1$-$C_5$ alkyl group's hydrogen atoms has been replaced with a —COOH group. Representative examples of an alkylcarboxy group include, but are not limited to, —CH$_2$COOH, —CH$_2$CH$_2$COOH, —CH$_2$CH$_2$CH$_2$COOH, —CH$_2$CH$_2$CH$_2$CH$_2$COOH, —CH$_2$CH(COOH)CH$_3$, —CH$_2$CH$_2$CH$_2$CH$_2$CH$_2$COOH, —CH$_2$CH(COOH)CH$_2$CH$_3$, —CH(COOH)CH$_2$CH$_3$ and —C(CH$_3$)$_2$CH$_2$COOH.

The term "cycloalkyl" as employed herein includes saturated and partially unsaturated cyclic hydrocarbon groups having 3 to 12 carbons, preferably 3 to 8 carbons, and more preferably 3 to 6 carbons, wherein the cycloalkyl group additionally is optionally substituted. Some cycloalkyl groups include, without limitation, cyclopropyl, cyclobutyl, cyclopentyl, cyclopentenyl, cyclohexyl, cyclohexenyl, cycloheptyl, and cyclooctyl.

The term "heteroaryl" refers to an aromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2, 3, or 4 atoms of each ring are substituted by a substituent. Examples of heteroaryl groups include pyridyl, furyl or furanyl, imidazolyl, benzimidazolyl, pyrimidinyl, thiophenyl or thienyl, quinolinyl, indolyl, thiazolyl, and the like.

The term "heteroarylalkyl" or the term "heteroaralkyl" refers to an alkyl substituted with a heteroaryl. The term "heteroarylalkoxy" refers to an alkoxy substituted with heteroaryl.

The term "heteroarylalkyl" or the term "heteroaralkyl" refers to an alkyl substituted with a heteroaryl. The term "heteroarylalkoxy" refers to an alkoxy substituted with heteroaryl.

The term "heterocyclyl" refers to a nonaromatic 5-8 membered monocyclic, 8-12 membered bicyclic, or 11-14 membered tricyclic ring system having 1-3 heteroatoms if monocyclic, 1-6 heteroatoms if bicyclic, or 1-9 heteroatoms if tricyclic, said heteroatoms selected from O, N, or S (e.g., carbon atoms and 1-3, 1-6, or 1-9 heteroatoms of O, N, or S if monocyclic, bicyclic, or tricyclic, respectively), wherein 0, 1, 2 or 3 atoms of each ring are substituted by a substituent. Examples of heterocyclyl groups include piperazinyl, pyrrolidinyl, dioxanyl, morpholinyl, tetrahydrofuranyl, and the like.

The term "substituent" refers to a group replacing a second atom or group such as a hydrogen atom on any molecule, compound or moiety. Suitable substituents include, without limitation, halo, hydroxy, mercapto, oxo, nitro, haloalkyl, alkyl, alkaryl, aryl, aralkyl, alkoxy, thioalkoxy, aryloxy, amino, alkoxycarbonyl, amido, carboxy, alkanesulfonyl, alkylcarbonyl, and cyano groups.

In some embodiments, the compounds disclosed herein contain one or more asymmetric centers and thus occur as racemates and racemic mixtures, single enantiomers, individual diastereomers and diastereomeric mixtures. All such isomeric forms of these compounds are included unless expressly provided otherwise. In some embodiments, the compounds disclosed herein are also represented in multiple tautomeric forms, in such instances, the compounds include all tautomeric forms of the compounds described herein (e.g., if alkylation of a ring system results in alkylation at multiple sites, the invention includes all such reaction products). All such isomeric forms of such compounds are included unless expressly provided otherwise. All crystal forms of the compounds described herein are included unless expressly provided otherwise.

As used herein, the terms "increase" and "decrease" mean, respectively, to cause a statistically significantly (i.e., $p<0.1$) increase or decrease of at least 5%.

As used herein, the recitation of a numerical range for a variable is intended to convey that the variable is equal to any of the values within that range. Thus, for a variable which is inherently discrete, the variable is equal to any integer value within the numerical range, including the end-points of the range. Similarly, for a variable which is inherently continuous, the variable is equal to any real value within the numerical range, including the end-points of the range. As an example, and without limitation, a variable which is described as having values between 0 and 2 takes the values 0, 1 or 2 if the variable is inherently discrete, and takes the values 0.0, 0.1, 0.01, 0.001, or any other real values $\geq 0$ and $\leq 2$ if the variable is inherently continuous.

As used herein, unless specifically indicated otherwise, the word "or" is used in the inclusive sense of "and/or" and not the exclusive sense of "either/or."

The term "on average" represents the mean value derived from performing at least three independent replicates for each data point.

The term "biological activity" encompasses structural and functional properties of a macrocycle. Biological activity is, for example, structural stability, alpha-helicity, affinity for a target, resistance to proteolytic degradation, cell penetrability, intracellular stability, in vivo stability, or any combination thereof.

The term "binding affinity" refers to the strength of a binding interaction, for example between a peptidomimetic macrocycle and a target. Binding affinity can be expressed, for example, as an equilibrium dissociation constant ("$K_D$"), which is expressed in units which are a measure of concentration (e.g. M, mM, μM, nM etc). Numerically, binding affinity and $K_D$ values vary inversely, such that a lower binding affinity corresponds to a higher $K_D$ value, while a higher binding affinity corresponds to a lower $K_D$ value. Where high binding affinity is desirable, "improved" binding affinity refers to higher binding affinity and therefore lower $K_D$ values.

The term "in vitro efficacy" refers to the extent to which a test compound, such as a peptidomimetic macrocycle, produces a beneficial result in an in vitro test system or assay. In vitro efficacy can be measured, for example, as an "$IC_{50}$" or "$EC_{50}$" value, which represents the concentration of the test compound which produces 50% of the maximal effect in the test system.

The term "ratio of in vitro efficacies" or "in vitro efficacy ratio" refers to the ratio of $IC_{50}$ or $EC_{50}$ values from a first assay (the numerator) versus a second assay (the denominator). Consequently, an improved in vitro efficacy ratio for Assay 1 versus Assay 2 refers to a lower value for the ratio expressed as $IC_{50}$(Assay 1)/$IC_{50}$(Assay 2) or alternatively as $EC_{50}$(Assay 1)/$EC_{50}$(Assay 2). This concept can also be characterized as "improved selectivity" in Assay 1 versus Assay 2, which can be due either to a decrease in the $IC_{50}$ or $EC_{50}$ value for Target 1 or an increase in the value for the $IC_{50}$ or $EC_{50}$ value for Target 2.

The details of one or more particular embodiments of the invention are set forth in the accompanying drawings and the description below. Other features, objects, and advantages of the invention will be apparent from the description and drawings, and from the claims.

Peptidomimetic Macrocycles

In some embodiments, a peptidomimetic macrocycle has the Formula (I):

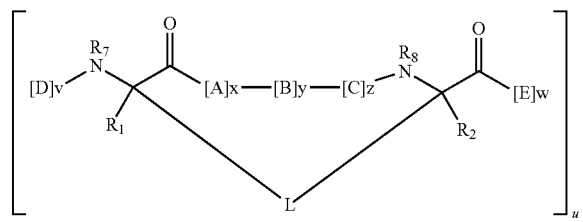

Formula I wherein:

each A, C, D, and E is independently an amino acid (including natural or non-natural amino acids, and amino acid analogs) and the terminal D and E independently optionally include a capping group;

B is an amino acid (including natural or non-natural amino acids, and amino acid analogs),

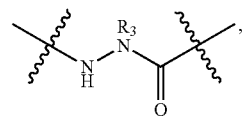

[—NH-L$_3$-CO—], [—NH-L$_3$-SO$_2$—], or [—NH-L$_3$-];

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

L is a macrocycle-forming linker of the formula -L$_1$-L$_2$-;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SOR$_E$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v and w are independently integers from 1-1000, for example 1-500, 1-200, 1-100, 1-50, 1-30, 1-20, or 1-10;

u is an integer from 1-10, for example 1-5, 1-3 or 1-2;

x, y and z are independently integers from 0-10, for example the sum of x+y+z is 2, 3, or 6; and n is an integer from 1-5.

In some embodiments, v and w are integers between 1-30. In some embodiments, w is an integer from 3-1000, for example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments, peptidomimetic macrocycles are also provided of the formula:

each K is O, S, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with a D residue;

$R_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$, or part of a cyclic structure with an E residue;

v is an integer from 1-1000, for example 1-500, 1-200, 1-100, 1-50, 1-30, 1-20 or 1-10;

w is an integer from 3-1000, for example 3-500, 3-200, 3-100, 3-50, 3-30, 3-20, or 3-10; and n is an integer from 1-5.

In some embodiments, v and w are integers between 1-30. In some embodiments, w is an integer from 3-1000, for

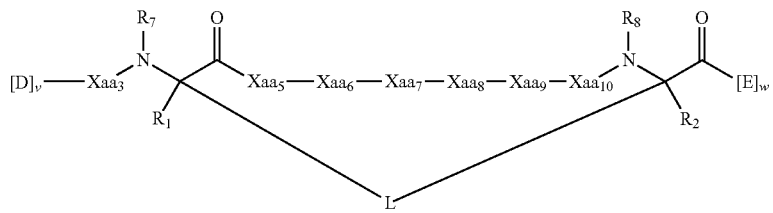

wherein:

each of $Xaa_3$, $Xaa_5$, $Xaa_6$, $Xaa_7$, $Xaa_8$, $Xaa_9$, and $Xaa_{10}$ is individually an amino acid, wherein at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8), where each X is an amino acid;

each D and E is independently an amino acid;

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

each L or L' is independently a macrocycle-forming linker of the formula -$L_1$-$L_2$-;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

each $R_4$ is alkylene, alkenylene, alkynylene, heteroalkylene, cycloalkylene, heterocycloalkylene, arylene, or heteroarylene;

example 3-500, 3-200, 3-100, 3-50, 3-30, 3-20, or 3-10. In some embodiments, the sum of x+y+z is 3 or 6. In some embodiments, the sum of x+y+z is 3. In other embodiments, the sum of x+y+z is 6.

In some embodiments of any of the Formulas described herein, at least three of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8). In other embodiments, at least four of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8). In other embodiments, at least five of $Xaa_3$, $Xaa_5$, $Xaa_6$, $Xaa_7$, $Xaa_8$, $Xaa_9$, and $Xaa_{10}$ are the same amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8). In other embodiments, at least six of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8). In other embodiments, at least seven of $Xaa_3$, $Xaa_5$, $Xaa_6$, $Xaa_7$, $Xaa_8$, $Xaa_9$, and $Xaa_{10}$ are the same amino acid as the amino acid at the corresponding position of the sequence $Phe_3$-$X_4$-$His_5$-$Tyr_6$-$Trp_7$-$Ala_8$-$Gln_9$-$Leu_{10}$-$X_{11}$-$Ser_{12}$ (SEQ ID NO: 8).

In some embodiments, a peptidomimetic macrocycle has the Formula:

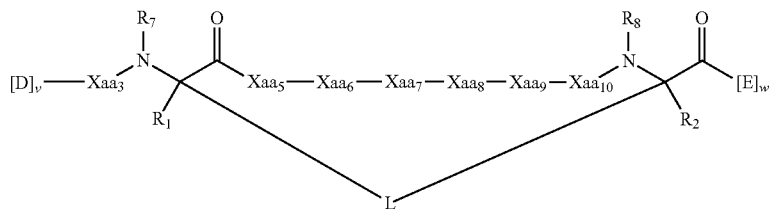

wherein:

each of Xaa$_3$, Xaa$_5$, Xaa$_6$, Xaa$_7$, Xaa$_8$, Xaa$_9$, and Xaa$_{10}$ is individually an amino acid, wherein at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9), where each X is an amino acid;

each D is independently an amino acid;

each E is independently an amino acid, for example an amino acid selected from Ala (alanine), D-Ala (D-alanine), Aib (α-aminoisobutyric acid), Sar (N-methyl glycine), and Ser (serine);

R$_1$ and R$_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of R$_1$ and R$_2$ forms a macrocycle-forming linker L' connected to the alpha position of one of said D or E amino acids;

each L or L' is independently a macrocycle-forming linker of the formula -L$_1$-L$_2$-;

L$_1$ and L$_2$ are independently alkylene, alkenylene, alkynylene, heteroalkylene, cycloalkylene, heterocycloalkylene, cycloarylene, heterocycloarylene, or [—R$_4$—K—R$_4$—]$_n$, each being optionally substituted with R$_5$;

R$_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with R$_5$;

each R$_4$ is alkylene, alkenylene, alkynylene, heteroalkylene, cycloalkylene, heterocycloalkylene, arylene, or heteroarylene;

each K is O, S, SO, SO$_2$, CO, CO$_2$, or CONR$_3$;

each R$_5$ is independently halogen, alkyl, —OR$_6$, —N(R$_6$)$_2$, —SR$_6$, —SOR$_6$, —SO$_2$R$_6$, —CO$_2$R$_6$, a fluorescent moiety, a radioisotope or a therapeutic agent;

each R$_6$ is independently —H, alkyl, alkenyl, alkynyl, arylalkyl, cycloalkylalkyl, heterocycloalkyl, a fluorescent moiety, a radioisotope or a therapeutic agent;

R$_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with a D residue;

R$_8$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with R$_5$, or part of a cyclic structure with an E residue;

v is an integer from 1-1000, for example 1-500, 1-200, 1-100, 1-50, 1-30, 1-20, or 1-10;

w is an integer from 3-1000, for example 3-500, 3-200, 3-100, 3-50, 3-30, 3-20, or 3-10; and n is an integer from 1-5.

In some embodiments of the above Formula, at least three of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9). In other embodiments of the above Formula, at least four of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9) In other embodiments of the above Formula, at least five of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9). In other embodiments of the above Formula, at least six of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9) In other embodiments of the above Formula, at least seven of Xaa$_3$, Xaa$_5$, Xaa$_6$, Xaa$_7$, Xaa$_8$, Xaa$_9$, and Xaa$_{10}$ are the same amino acid as the amino acid at the corresponding position of the sequence Phe$_3$-X$_4$-Glu$_5$-Tyr$_6$-Trp$_7$-Ala$_8$-Gln$_9$-Leu$_{10}$/Cba$_{10}$-X$_{11}$-Ala$_{12}$ (SEQ ID NO: 9).

In some embodiments, w is an integer from 3-10, for example 3-6, 3-8, 6-8, or 6-10. In some embodiments, w is 3. In other embodiments, w is 6. In some embodiments, v is an integer from 1-10, for example 2-5. In some embodiments, v is 2.

In an embodiment of any of the Formulas described herein, L$_1$ and L$_2$, either alone or in combination, do not form a triazole or a thioether.

In one example, at least one of R$_1$ and R$_2$ is alkyl, unsubstituted or substituted with halo-. In another example, both R$_1$ and R$_2$ are independently alkyl, unsubstituted or substituted with halo-. In some embodiments, at least one of R$_1$ and R$_2$ is methyl. In other embodiments, R$_1$ and R$_2$ are methyl.

In some embodiments, x+y+z is at least 3. In other embodiments, x+y+z is 1, 2, 3, 4, 5, 6, 7, 8, 9 or 10. In some embodiments, the sum of x+y+z is 3 or 6. In some embodiments, the sum of x+y+z is 3. In other embodiments, the sum of x+y+z is 6. Each occurrence of A, B, C, D or E in a macrocycle or macrocycle precursor is independently selected. For example, a sequence represented by the formula [A], when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges. Similarly, when u is greater than 1, each compound can encompass peptidomimetic macrocycles which are the same or different. For example, a compound can comprise peptidomimetic macrocycles comprising different linker lengths or chemical compositions.

In some embodiments, the peptidomimetic macrocycle comprises a secondary structure which is an α-helix and R$_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

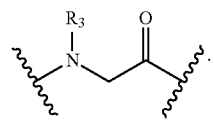

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

In one embodiment, the peptidomimetic macrocycle of Formula (I) is:

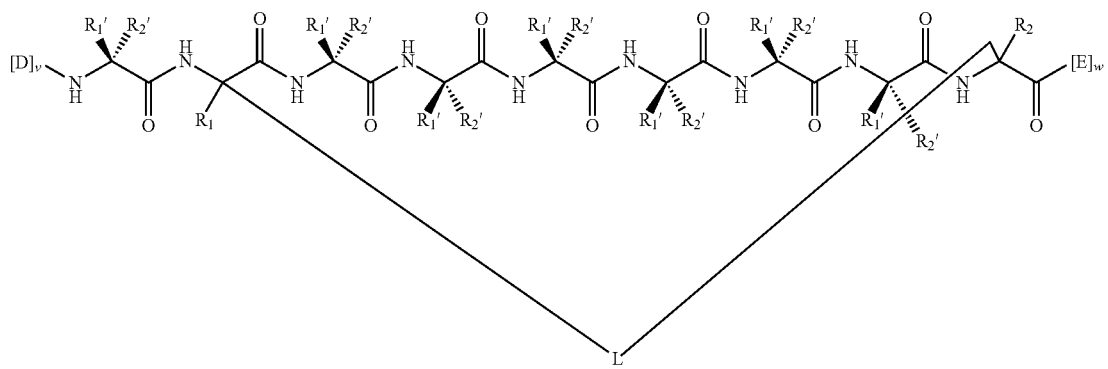

wherein each $R_1$ and $R_2$ is independently independently —H, alkyl, alkenyl, alkynyl, arylalkyl, cycloalkyl, cycloalkylalkyl, heteroalkyl, or heterocycloalkyl, unsubstituted or substituted with halo-.

In related embodiments, the peptidomimetic macrocycle of Formula (I) is:

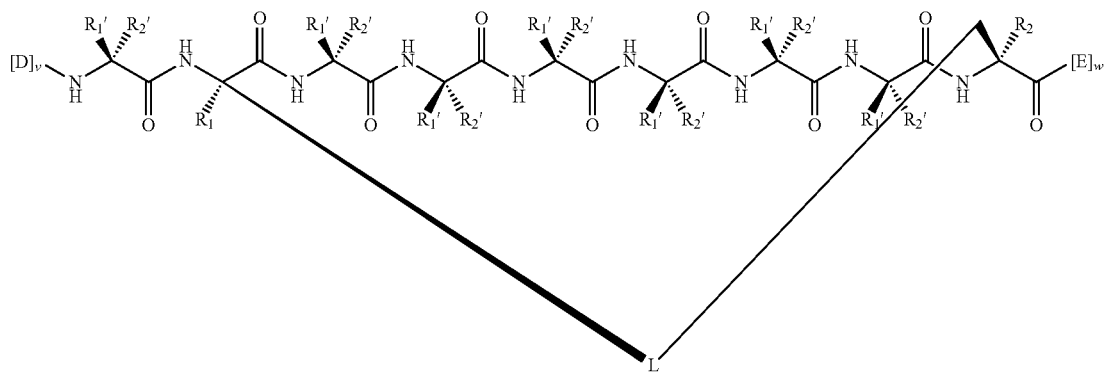

wherein each $R_1'$ and $R_2'$ is independently an amino acid.

In other embodiments, the peptidomimetic macrocycle of Formula (I) is a compound of any of the formulas shown below:
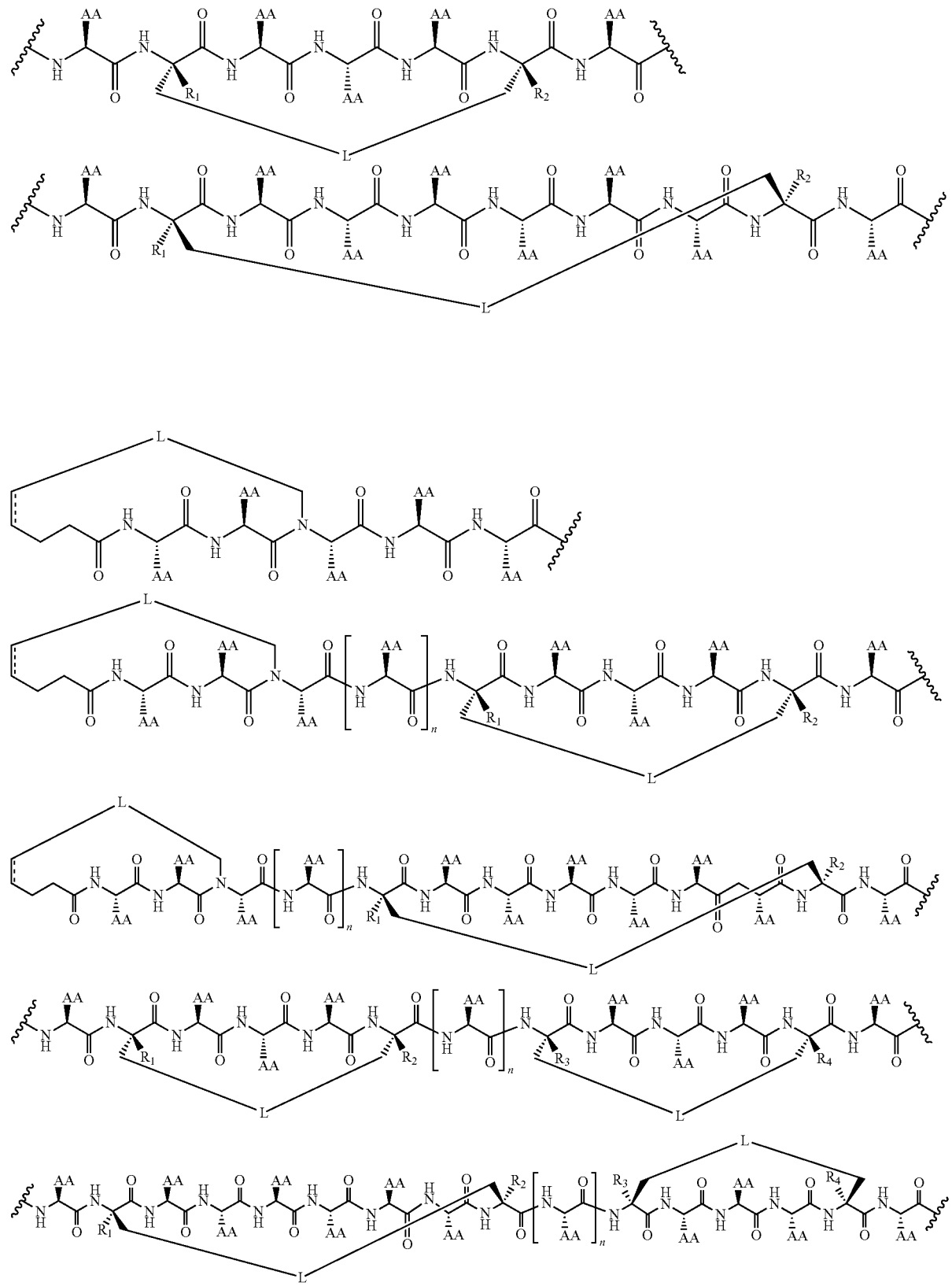

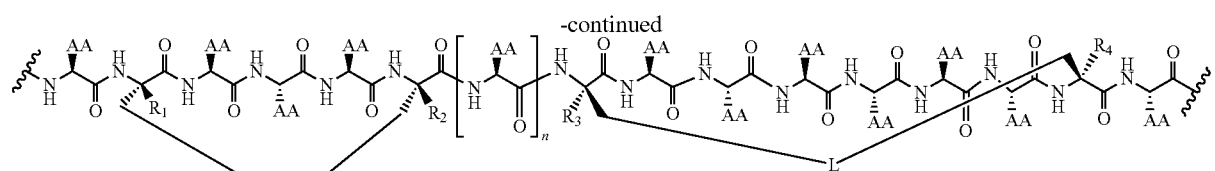
-continued
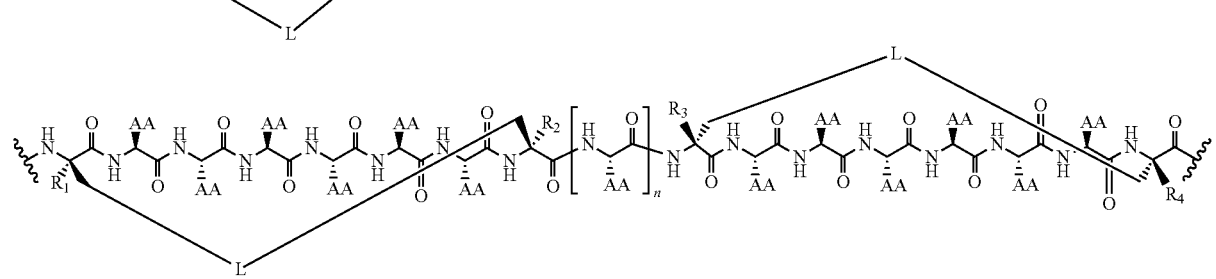
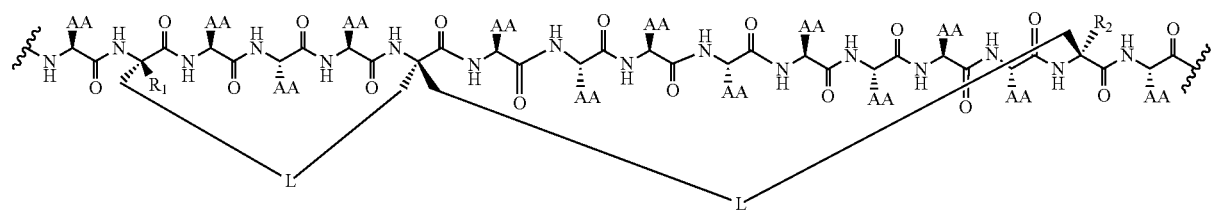
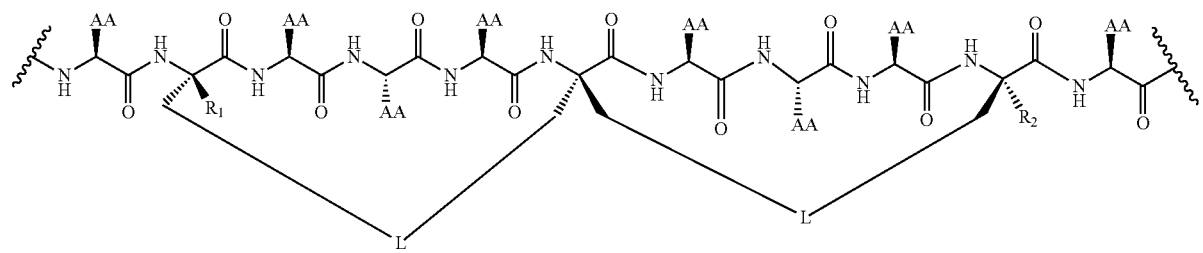
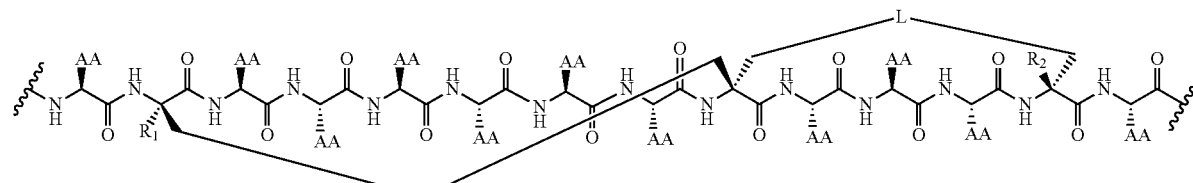
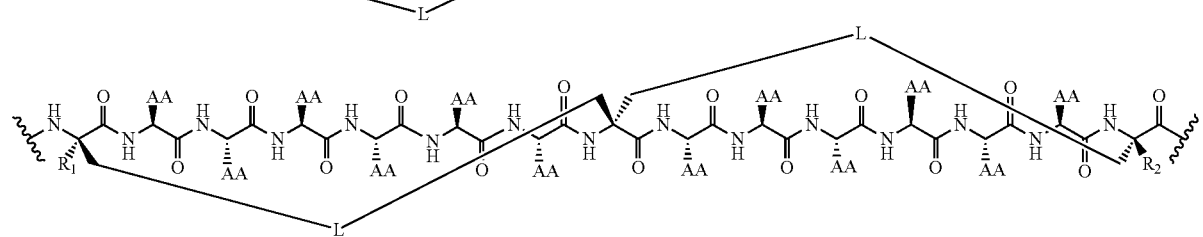
wherein "AA" represents any natural or non-natural amino acid side chain and "⌇" is $[D]_v$, $[E]_w$ as defined above, and n is an integer between 0 and 20, 50, 100, 200, 300, 400 or 500. In some embodiments, n is 0. In other embodiments, n is less than 50.
Exemplary embodiments of the macrocycle-forming linker L are shown below.
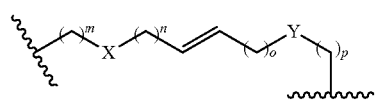
where X, Y = —$CH_2$—,
O, S, or NH
m, n, o, p = 0-10

-continued

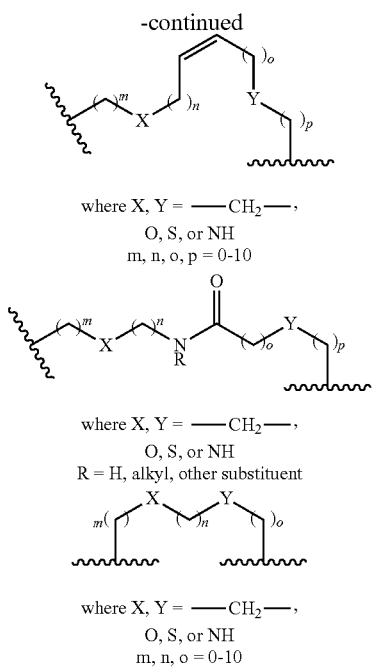

where X, Y = —CH₂—,
O, S, or NH
m, n, o, p = 0-10 where X, Y = —CH₂—,
O, S, or NH
R = H, alkyl, other substituent where X, Y = —CH₂—,
O, S, or NH
m, n, o = 0-10

In other embodiments, D and/or E in the compound of Formula I are further modified in order to facilitate cellular uptake. In some embodiments, lipidating or PEGylating a peptidomimetic macrocycle facilitates cellular uptake, increases bioavailability, increases blood circulation, alters pharmacokinetics, decreases immunogenicity and/or decreases the needed frequency of administration.

In other embodiments, at least one of [D] and [E] in the compound of Formula I represents a moiety comprising an additional macrocycle-forming linker such that the peptidomimetic macrocycle comprises at least two macrocycle-forming linkers. In a specific embodiment, a peptidomimetic macrocycle comprises two macrocycle-forming linkers. In an embodiment, u is 2.

In some embodiments, any of the macrocycle-forming linkers described herein can be used in any combination with any of the sequences shown in Table 1, Table 1a, Table 1b, or Table 1c and also with any of the R-substituents indicated herein.

In some embodiments, the peptidomimetic macrocycle comprises at least one α-helix motif. For example, A, B and/or C in the compound of Formula I include one or more α-helices. As a general matter, α-helices include between 3 and 4 amino acid residues per turn. In some embodiments, the α-helix of the peptidomimetic macrocycle includes 1 to 5 turns and, therefore, 3 to 20 amino acid residues. In specific embodiments, the α-helix includes 1 turn, 2 turns, 3 turns, 4 turns, or 5 turns. In some embodiments, the macrocycle-forming linker stabilizes an α-helix motif included within the peptidomimetic macrocycle. Thus, in some embodiments, the length of the macrocycle-forming linker L from a first Cα to a second Cα is selected to increase the stability of an α-helix. In some embodiments, the macrocycle-forming linker spans from 1 turn to 5 turns of the α-helix. In some embodiments, the macrocycle-forming linker spans approximately 1 turn, 2 turns, 3 turns, 4 turns, or 5 turns of the α-helix. In some embodiments, the length of the macrocycle-forming linker is approximately 5 Å to 9 Å per turn of the α-helix, or approximately 6 Å to 8 Å per turn of the α-helix. Where the macrocycle-forming linker spans approximately 1 turn of an α-helix, the length is equal to approximately 5 carbon-carbon bonds to 13 carbon-carbon bonds, approximately 7 carbon-carbon bonds to 11 carbon-carbon bonds, or approximately 9 carbon-carbon bonds. Where the macrocycle-forming linker spans approximately 2 turns of an α-helix, the length is equal to approximately 8 carbon-carbon bonds to 16 carbon-carbon bonds, approximately 10 carbon-carbon bonds to 14 carbon-carbon bonds, or approximately 12 carbon-carbon bonds. Where the macrocycle-forming linker spans approximately 3 turns of an α-helix, the length is equal to approximately 14 carbon-carbon bonds to 22 carbon-carbon bonds, approximately 16 carbon-carbon bonds to 20 carbon-carbon bonds, or approximately 18 carbon-carbon bonds. Where the macrocycle-forming linker spans approximately 4 turns of an α-helix, the length is equal to approximately 20 carbon-carbon bonds to 28 carbon-carbon bonds, approximately 22 carbon-carbon bonds to 26 carbon-carbon bonds, or approximately 24 carbon-carbon bonds. Where the macrocycle-forming linker spans approximately 5 turns of an α-helix, the length is equal to approximately 26 carbon-carbon bonds to 34 carbon-carbon bonds, approximately 28 carbon-carbon bonds to 32 carbon-carbon bonds, or approximately 30 carbon-carbon bonds. Where the macrocycle-forming linker spans approximately 1 turn of an α-helix, the linkage contains approximately 4 atoms to 12 atoms, approximately 6 atoms to 10 atoms, or approximately 8 atoms. Where the macrocycle-forming linker spans approximately 2 turns of the α-helix, the linkage contains approximately 7 atoms to 15 atoms, approximately 9 atoms to 13 atoms, or approximately 11 atoms. Where the macrocycle-forming linker spans approximately 3 turns of the α-helix, the linkage contains approximately 13 atoms to 21 atoms, approximately 15 atoms to 19 atoms, or approximately 17 atoms. Where the macrocycle-forming linker spans approximately 4 turns of the α-helix, the linkage contains approximately 19 atoms to 27 atoms, approximately 21 atoms to 25 atoms, or approximately 23 atoms. Where the macrocycle-forming linker spans approximately 5 turns of the α-helix, the linkage contains approximately 25 atoms to 33 atoms, approximately 27 atoms to 31 atoms, or approximately 29 atoms. Where the macrocycle-forming linker spans approximately 1 turn of the α-helix, the resulting macrocycle forms a ring containing approximately 17 members to 25 members, approximately 19 members to 23 members, or approximately 21 members. Where the macrocycle-forming linker spans approximately 2 turns of the α-helix, the resulting macrocycle forms a ring containing approximately 29 members to 37 members, approximately 31 members to 35 members, or approximately 33 members. Where the macrocycle-forming linker spans approximately 3 turns of the α-helix, the resulting macrocycle forms a ring containing approximately 44 members to 52 members, approximately 46 members to 50 members, or approximately 48 members. Where the macrocycle-forming linker spans approximately 4 turns of the α-helix, the resulting macrocycle forms a ring containing approximately 59 members to 67 members, approximately 61 members to 65 members, or approximately 63 members. Where the macrocycle-forming linker spans approximately 5 turns of the α-helix, the resulting macrocycle forms a ring containing approximately 74 members to 82 members, approximately 76 members to 80 members, or approximately 78 members.

In other embodiments, provided are peptidomimetic macrocycles of Formula (IV) or (IVa):

Formula (IV)

Formula (IVa)

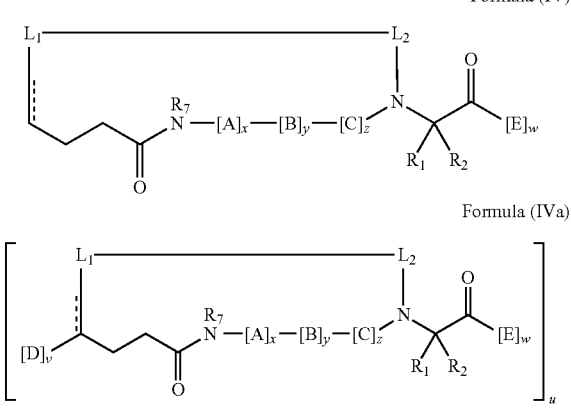

wherein:

each A, C, D, and E is independently a natural or non-natural amino acid, and the terminal D and E independently optionally include a capping group;

B is a natural or non-natural amino acid, amino acid analog,

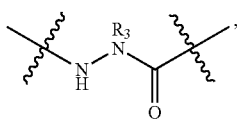

[—NH-$L_3$-CO—], [—NH-$L_3$-$SO_2$—], or [—NH-$L_3$-];

$R_1$ and $R_2$ are independently —H, alkyl, alkenyl, alkynyl, arylalkyl, cycloalkyl, cycloalkylalkyl, heteroalkyl, or heterocycloalkyl, unsubstituted or substituted with halo-; or at least one of $R_1$ and $R_2$ forms a macrocycle-forming linker L' connected to the alpha position of one of said D or E amino acids;

$R_3$ is hydrogen, alkyl, alkenyl, alkynyl, arylalkyl, heteroalkyl, cycloalkyl, heterocycloalkyl, cycloalkylalkyl, cycloaryl, or heterocycloaryl, optionally substituted with $R_5$;

L is a macrocycle-forming linker of the formula -$L_1$-$L_2$-;

$L_1$ and $L_2$ are independently alkylene, alkenylene, alkynylene, heteroalkylene, cycloalkylene, heterocycloalkylene, cycloarylene, heterocycloarylene, or [—$R_4$—K—$R_4$—]$_n$, each being optionally substituted with $R_5$;

each $R_4$ is alkylene, alkenylene, alkynylene, heteroalkylene, cycloalkylene, heterocycloalkylene, arylene, or heteroarylene;

each K is O, S, SO, $SO_2$, CO, $CO_2$, or $CONR_3$;

each $R_5$ is independently halogen, alkyl, —$OR_6$, —N($R_6$)$_2$, —$SR_6$, —$SOR_E$, —$SO_2R_6$, —$CO_2R_6$, a fluorescent moiety, a radioisotope or a therapeutic agent;

each $R_6$ is independently —H, alkyl, alkenyl, alkynyl, arylalkyl, cycloalkylalkyl, heterocycloalkyl, a fluorescent moiety, a radioisotope or a therapeutic agent;

$R_7$ is —H, alkyl, alkenyl, alkynyl, arylalkyl, cycloalkyl, heteroalkyl, cycloalkylalkyl, heterocycloalkyl, cycloaryl, or heterocycloaryl, optionally substituted with $R_5$;

v and w are independently integers from 1-1000;

u is an integer from 1-10;

x, y and z are independently integers from 0-10; and n is an integer from 1-5.

In one example, $L_1$ and $L_2$, either alone or in combination, do not form a triazole or a thioether.

In one example, at least one of $R_1$ and $R_2$ is alkyl, unsubstituted or substituted with halo-. In another example, both $R_1$ and $R_2$ are independently alkyl, unsubstituted or substituted with halo-. In some embodiments, at least one of $R_1$ and $R_2$ is methyl. In other embodiments, $R_1$ and $R_2$ are methyl.

In some embodiments, x+y+z is at least 1. In other embodiments, x+y+z is at least 2. In other embodiments, x+y+z is 1, 2, 3, 4, 5, 6, 7, 8, 9 or 10. Each occurrence of A, B, C, D or E in a macrocycle or macrocycle precursor is independently selected. For example, a sequence represented by the formula [A], when x is 3, encompasses embodiments where the amino acids are not identical, e.g. Gln-Asp-Ala as well as embodiments where the amino acids are identical, e.g. Gln-Gln-Gln. This applies for any value of x, y, or z in the indicated ranges.

In some embodiments, the peptidomimetic macrocycle comprises a secondary structure which is an α-helix and $R_8$ is —H, allowing intrahelical hydrogen bonding. In some embodiments, at least one of A, B, C, D or E is an α,α-disubstituted amino acid. In one example, B is an α,α-disubstituted amino acid. For instance, at least one of A, B, C, D or E is 2-aminoisobutyric acid. In other embodiments, at least one of A, B, C, D or E is

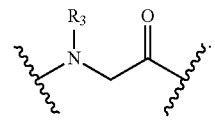

In other embodiments, the length of the macrocycle-forming linker L as measured from a first Cα to a second Cα is selected to stabilize a desired secondary peptide structure, such as an α-helix formed by residues of the peptidomimetic macrocycle including, but not necessarily limited to, those between the first Cα to a second Cα.

Exemplary embodiments of the macrocycle-forming linker -$L_1$-$L_2$- are shown below.

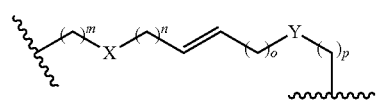

where X, Y = —$CH_2$—,
O, S, or NH
m, n, o, p = 0-10

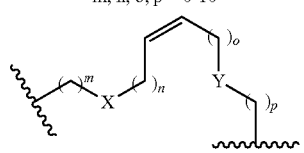

where X, Y = —$CH_2$—,
O, S, or NH
m, n, o, p = 0-10

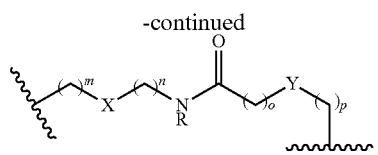

where X, Y = —CH$_2$—,
O, S, or NH
R = H, alkyl, other substituent

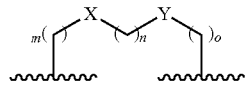

where X, Y = —CH$_2$—,
O, S, or NH
m, n, o = 0-10

Unless otherwise stated, any compounds (including peptidomimetic macrocycles, macrocycle precursors, and other compositions) are also meant to encompass compounds which differ only in the presence of one or more isotopically enriched atoms. For example, compounds having the described structures except for the replacement of a hydrogen by a deuterium or tritium, or the replacement of a carbon by $^{13}$C- or $^{14}$C-enriched carbon are within the scope of this invention.

In some embodiments, the compounds disclosed herein can contain unnatural proportions of atomic isotopes at one or more of atoms that constitute such compounds. For example, the compounds can be radiolabeled with radioactive isotopes, such as for example tritium ($^3$H), iodine-125 ($^{125}$I) or carbon-14 ($^{14}$C). In other embodiments, one or more carbon atoms is replaced with a silicon atom. All isotopic variations of the compounds disclosed herein, whether radioactive or not, are contemplated herein.

Preparation of Peptidomimetic Macrocycles

Peptidomimetic macrocycles can be prepared by any of a variety of methods known in the art. For example, any of the residues indicated by "$" or "$r8" in Table 1, Table 1a, Table 1b, or Table 1c can be substituted with a residue capable of forming a crosslinker with a second residue in the same molecule or a precursor of such a residue.

Various methods to effect formation of peptidomimetic macrocycles are known in the art. For example, the preparation of peptidomimetic macrocycles of Formula I is described in Schafmeister et al., J. Am. Chem. Soc. 122: 5891-5892 (2000); Schafmeister & Verdine, J. Am. Chem. Soc. 122:5891 (2005); Walensky et al., Science 305:1466-1470 (2004); U.S. Pat. No. 7,192,713 and PCT application WO 2008/121767. The α,α-disubstituted amino acids and amino acid precursors disclosed in the cited references can be employed in synthesis of the peptidomimetic macrocycle precursor polypeptides. For example, the "S5-olefin amino acid" is (S)-α-(2'-pentenyl) alanine and the "R8 olefin amino acid" is (R)-α-(2'-octenyl) alanine. Following incorporation of such amino acids into precursor polypeptides, the terminal olefins are reacted with a metathesis catalyst, leading to the formation of the peptidomimetic macrocycle. In various embodiments, the following amino acids can be employed in the synthesis of the peptidomimetic macrocycle:

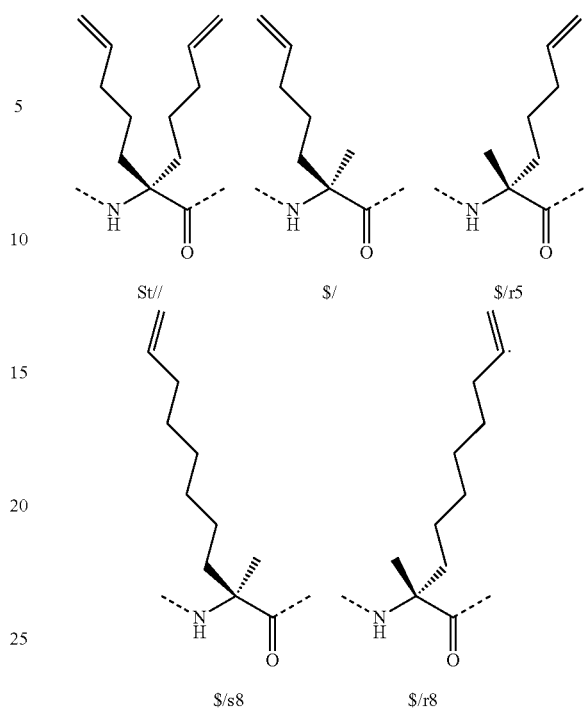

In other embodiments, the peptidomimetic macrocycles are of Formula IV or IVa. Methods for the preparation of such macrocycles are described, for example, in U.S. Pat. No. 7,202,332.

Additional methods of forming peptidomimetic macrocycles which are envisioned as suitable include those disclosed by Mustapa, M. Firouz Mohd et al., J. Org. Chem (2003), 68, pp. 8193-8198; Yang, Bin et al. Bioorg Med. Chem. Lett. (2004), 14, pp. 1403-1406; U.S. Pat. No. 5,364,851; U.S. Pat. No. 5,446,128; U.S. Pat. No. 5,824,483; U.S. Pat. No. 6,713,280; and U.S. Pat. No. 7,202,332. In such embodiments, amino acid precursors are used containing an additional substituent R— at the alpha position. Such amino acids are incorporated into the macrocycle precursor at the desired positions, which can be at the positions where the crosslinker is substituted or, alternatively, elsewhere in the sequence of the macrocycle precursor. Cyclization of the precursor is then effected according to the indicated method.

Assays

The properties of peptidomimetic macrocycles are assayed, for example, by using the methods described below. In some embodiments, a peptidomimetic macrocycle has improved biological properties relative to a corresponding polypeptide lacking the substituents described herein.

Assay to Determine α-Helicity

In solution, the secondary structure of polypeptides with α-helical domains will reach a dynamic equilibrium between random coil structures and α-helical structures, often expressed as a "percent helicity". Thus, for example, alpha-helical domains are predominantly random coils in solution, with α-helical content usually under 25%. Peptidomimetic macrocycles with optimized linkers, on the other hand, possess, for example, an alpha-helicity that is at least two-fold greater than that of a corresponding uncrosslinked polypeptide. In some embodiments, macrocycles will possess an alpha-helicity of greater than 50%. To assay the helicity of peptidomimetic macrocycles, the compounds are dissolved in an aqueous solution (e.g. 50 mM potassium phosphate solution at pH 7, or distilled H$_2$O, to concentrations of 25-50 µM). Circular dichroism (CD) spectra are obtained on a spectropolarimeter (e.g., Jasco J-710) using standard measurement parameters (e.g. temperature, 20° C.; wavelength, 190-260 nm; step resolution, 0.5 nm; speed, 20 nm/sec; accumulations, 10; response, 1 sec; bandwidth, 1 nm; path length, 0.1 cm). The α-helical content of each peptide is calculated by dividing the mean residue ellipticity (e.g. [Φ]222obs) by the reported value for a model helical decapeptide (Yang et al. (1986), *Methods Enzymol.* 130: 208)).

Assay to Determine Melting Temperature (Tm).

A peptidomimetic macrocycle comprising a secondary structure such as an α-helix exhibits, for example, a higher melting temperature than a corresponding uncrosslinked polypeptide. Typically peptidomimetic macrocycles exhibit Tm of >60° C. representing a highly stable structure in aqueous solutions. To assay the effect of macrocycle formation on melting temperature, peptidomimetic macrocycles or unmodified peptides are dissolved in distilled H$_2$O (e.g. at a final concentration of 50 µM) and the Tm is determined by measuring the change in ellipticity over a temperature range (e.g. 4 to 95° C.) on a spectropolarimeter (e.g., Jasco J-710) using standard parameters (e.g. wavelength 222 nm; step resolution, 0.5 nm; speed, 20 nm/sec; accumulations, 10; response, 1 sec; bandwidth, 1 nm; temperature increase rate: 1° C./min; path length, 0.1 cm).

Protease Resistance Assay.

The amide bond of the peptide backbone is susceptible to hydrolysis by proteases, thereby rendering peptidic compounds vulnerable to rapid degradation in vivo. Peptide helix formation, however, typically buries the amide backbone and therefore can shield it from proteolytic cleavage. The peptidomimetic macrocycles can be subjected to in vitro trypsin proteolysis to assess for any change in degradation rate compared to a corresponding uncrosslinked polypeptide. For example, the peptidomimetic macrocycle and a corresponding uncrosslinked polypeptide are incubated with trypsin agarose and the reactions quenched at various time points by centrifugation and subsequent HPLC injection to quantitate the residual substrate by ultraviolet absorption at 280 nm. Briefly, the peptidomimetic macrocycle and peptidomimetic precursor (5 mcg) are incubated with trypsin agarose (Pierce) (S/E ~125) for 0, 10, 20, 90, and 180 minutes. Reactions are quenched by tabletop centrifugation at high speed; remaining substrate in the isolated supernatant is quantified by HPLC-based peak detection at 280 nm. The proteolytic reaction displays first order kinetics and the rate constant, k, is determined from a plot of ln[S] versus time (k=−1×slope).

Ex Vivo Stability Assay.

Peptidomimetic macrocycles with optimized linkers possess, for example, an ex vivo half-life that is at least two-fold greater than that of a corresponding uncrosslinked polypeptide, and possess an ex vivo half-life of 12 hours or more. For ex vivo serum stability studies, a variety of assays can be used. For example, a peptidomimetic macrocycle and a corresponding uncrosslinked polypeptide (2 mcg) are incubated with fresh mouse, rat and/or human serum (2 mL) at 37° C. for 0, 1, 2, 4, 8, and 24 hours. To determine the level of intact compound, the following procedure can be used: The samples are extracted by transferring 100 µl of sera to 2 ml centrifuge tubes followed by the addition of 10 µL of 50% formic acid and 500 µL acetonitrile and centrifugation at 14,000 RPM for 10 min at 4±2° C. The supernatants are then transferred to fresh 2 ml tubes and evaporated on Turbovap under N$_2$<10 psi, 37° C. The samples are reconstituted in 100 µL of 50:50 acetonitrile:water and submitted to LC-MS/MS analysis.

In Vitro Binding Assays.

To assess the binding and affinity of peptidomimetic macrocycles and peptidomimetic precursors to acceptor proteins, a fluorescence polarization assay (FPA) is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution).

For example, fluoresceinated peptidomimetic macrocycles (25 nM) are incubated with the acceptor protein (25-1000 nM) in binding buffer (140 mM NaCl, 50 mM Tris-HCL, pH 7.4) for 30 minutes at room temperature. Binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.). A peptidomimetic macrocycle shows, In some embodiments, similar or lower Kd than a corresponding uncrosslinked polypeptide.

In Vitro Displacement Assays to Characterize Antagonists of Peptide-Protein Interactions.

To assess the binding and affinity of compounds that antagonize the interaction between a peptide and an acceptor protein, a fluorescence polarization assay (FPA) utilizing a fluoresceinated peptidomimetic macrocycle derived from a peptidomimetic precursor sequence is used, for example. The FPA technique measures the molecular orientation and mobility using polarized light and fluorescent tracer. When excited with polarized light, fluorescent tracers (e.g., FITC) attached to molecules with high apparent molecular weights (e.g. FITC-labeled peptides bound to a large protein) emit higher levels of polarized fluorescence due to their slower rates of rotation as compared to fluorescent tracers attached to smaller molecules (e.g. FITC-labeled peptides that are free in solution). A compound that antagonizes the interaction between the fluoresceinated peptidomimetic macrocycle and an acceptor protein will be detected in a competitive binding FPA experiment.

For example, putative antagonist compounds (1 nM to 1 mM) and a fluoresceinated peptidomimetic macrocycle (25 nM) are incubated with the acceptor protein (50 nM) in binding buffer (140 mM NaCl, 50 mM Tris-HCL, pH 7.4) for 30 minutes at room temperature. Antagonist binding activity is measured, for example, by fluorescence polarization on a luminescence spectrophotometer (e.g. Perkin-Elmer LS50B). Kd values can be determined by nonlinear regression analysis using, for example, Graphpad Prism software (GraphPad Software, Inc., San Diego, Calif.).

Any class of molecule, such as small organic molecules, peptides, oligonucleotides or proteins can be examined as putative antagonists in this assay.

Assay for Protein-Ligand Binding by Affinity Selection-Mass Spectrometry

To assess the binding and affinity of test compounds for proteins, an affinity-selection mass spectrometry assay is used, for example. Protein-ligand binding experiments are conducted according to the following representative procedure outlined for a system-wide control experiment using 1

μM peptidomimetic macrocycle plus 5 μM hMDM2. A 1 μL DMSO aliquot of a 40 μM stock solution of peptidomimetic macrocycle is dissolved in 19 μL of PBS (Phosphate-buffered saline: 50 mM, pH 7.5 Phosphate buffer containing 150 mM NaCl). The resulting solution is mixed by repeated pipetting and clarified by centrifugation at 10 000 g for 10 min To a 4 μL aliquot of the resulting supernatant is added 4 μL of 10 μM hMDM2 in PBS. Each 8.0 μL experimental sample thus contains 40 pmol (1.5 μg) of protein at 5.0 μM concentration in PBS plus 1 μM peptidomimetic macrocycle and 2.5% DMSO. Duplicate samples thus prepared for each concentration point are incubated for 60 min at room temperature, and then chilled to 4° C. prior to size-exclusion chromatography-LC-MS analysis of 5.0 μL injections. Samples containing a target protein, protein-ligand complexes, and unbound compounds are injected onto an SEC column, where the complexes are separated from non-binding component by a rapid SEC step. The SEC column eluate is monitored using UV detectors to confirm that the early-eluting protein fraction, which elutes in the void volume of the SEC column, is well resolved from unbound components that are retained on the column After the peak containing the protein and protein-ligand complexes elutes from the primary UV detector, it enters a sample loop where it is excised from the flow stream of the SEC stage and transferred directly to the LC-MS via a valving mechanism. The $(M+3H)^{3+}$ ion of the peptidomimetic macrocycle is observed by ESI-MS at the expected m/z, confirming the detection of the protein-ligand complex.

Assay for Protein-Ligand Kd Titration Experiments.

To assess the binding and affinity of test compounds for proteins, a protein-ligand Kd titration experiment is performed, for example. Protein-ligand $K_d$ titrations experiments are conducted as follows: 2 μL DMSO aliquots of a serially diluted stock solution of titrant peptidomimetic macrocycle (5, 2.5, . . . , 0.098 mM) are prepared then dissolved in 38 μL of PBS. The resulting solutions are mixed by repeated pipetting and clarified by centrifugation at 10 000 g for 10 min To 4.0 μL aliquots of the resulting supernatants is added 4.0 μL of 10 μM hMDM2 in PBS. Each 8.0 μL experimental sample thus contains 40 pmol (1.5 μg) of protein at 5.0 μM concentration in PBS, varying concentrations (125, 62.5, . . . , 0.24 μM) of the titrant peptide, and 2.5% DMSO. Duplicate samples thus prepared for each concentration point are incubated at room temperature for 30 min, then chilled to 4° C. prior to SEC-LC-MS analysis of 2.0 μL injections. The $(M+H)^{1+}$, $(M+2H)^{2+}$, $(M+3H)^{3+}$, and/or $(M+Na)^{1+}$ ion is observed by ESI-MS; extracted ion chromatograms are quantified, then fit to equations to derive the binding affinity $K_d$ as described in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Assay for Competitive Binding Experiments by Affinity Selection-Mass Spectrometry To determine the ability of test compounds to bind competitively to proteins, an affinity selection mass spectrometry assay is performed, for example. A mixture of ligands at 40 μM per component is prepared by combining 2 μL aliquots of 400 μM stocks of each of the three compounds with 14 μL of DMSO. Then, 1 μL at aliquots of this 40 μM per component mixture are combined with 1 μL DMSO aliquots of a serially diluted stock solution of titrant peptidomimetic macrocycle (10, 5, 2.5, . . . , 0.078 mM). These 2 μL samples are dissolved in 38 μL of PBS. The resulting solutions were mixed by repeated pipetting and clarified by centrifugation at 10 000 g for 10 min To 4.0 μL aliquots of the resulting supernatants is added 4.0 μL of 10 μM hMDM2 protein in PBS. Each 8.0 μL experimental sample thus contains 40 pmol (1.5 μg) of protein at 5.0 μM concentration in PBS plus 0.5 μM ligand, 2.5% DMSO, and varying concentrations (125, 62.5, . . . , 0.98 μM) of the titrant peptidomimetic macrocycle. Duplicate samples thus prepared for each concentration point are incubated at room temperature for 60 min, then chilled to 4° C. prior to SEC-LC-MS analysis of 2.0 μL injections. Additional details on these and other methods are provided in "*A General Technique to Rank Protein-Ligand Binding Affinities and Determine Allosteric vs. Direct Binding Site Competition in Compound Mixtures.*" Annis, D. A.; Nazef, N.; Chuang, C. C.; Scott, M. P.; Nash, H. M. *J. Am. Chem. Soc.* 2004, 126, 15495-15503; also in "*ALIS: An Affinity Selection-Mass Spectrometry System for the Discovery and Characterization of Protein-Ligand Interactions*" D. A. Annis, C.-C. Chuang, and N. Nazef. In Mass Spectrometry in Medicinal Chemistry. Edited by Wanner K, Höfner G: Wiley-VCH; 2007:121-184. Mannhold R, Kubinyi H, Folkers G (Series Editors): Methods and Principles in Medicinal Chemistry.

Binding Assays in Intact Cells.

It is possible to measure binding of peptides or peptidomimetic macrocycles to their natural acceptors in intact cells by immunoprecipitation experiments. For example, intact cells are incubated with fluoresceinated (FITC-labeled) compounds for 4 hrs in the absence of serum, followed by serum replacement and further incubation that ranges from 4-18 hrs. Cells are then pelleted and incubated in lysis buffer (50 mM Tris [pH 7.6], 150 mM NaCl, 1% CHAPS and protease inhibitor cocktail) for 10 minutes at 4° C. Extracts are centrifuged at 14,000 rpm for 15 minutes and supernatants collected and incubated with 10 μl goat anti-FITC antibody for 2 hrs, rotating at 4° C. followed by further 2 hrs incubation at 4° C. with protein A/G Sepharose (50 μl of 50% bead slurry). After quick centrifugation, the pellets are washed in lysis buffer containing increasing salt concentration (e.g., 150, 300, 500 mM). The beads are then re-equilibrated at 150 mM NaCl before addition of SDS-containing sample buffer and boiling. After centrifugation, the supernatants are optionally electrophoresed using 4%-12% gradient Bis-Tris gels followed by transfer into Immobilon-P membranes. After blocking, blots are optionally incubated with an antibody that detects FITC and also with one or more antibodies that detect proteins that bind to the peptidomimetic macrocycle.

Cellular Penetrability Assays.

A peptidomimetic macrocycle is, for example, more cell penetrable compared to a corresponding uncrosslinked macrocycle. Peptidomimetic macrocycles with optimized linkers possess, for example, cell penetrability that is at least two-fold greater than a corresponding uncrosslinked macrocycle, and often 20% or more of the applied peptidomimetic macrocycle will be observed to have penetrated the cell after 4 hours. To measure the cell penetrability of peptidomimetic macrocycles and corresponding uncrosslinked macrocycle, intact cells are incubated with fluorescently-labeled (e.g. fluoresceinated) peptidomimetic macrocycles or corresponding uncrosslinked macrocycle (10 µM) for 4 hrs in serum free media at 37° C., washed twice with media and incubated with trypsin (0.25%) for 10 min at 37° C. The cells are washed again and resuspended in PBS. Cellular fluorescence is analyzed, for example, by using either a FACSCalibur flow cytometer or Cellomics' KineticScan® HCS Reader.

Cellular Efficacy Assays.

The efficacy of certain peptidomimetic macrocycles is determined, for example, in cell-based killing assays using a variety of tumorigenic and non-tumorigenic cell lines and primary cells derived from human or mouse cell populations. Cell viability is monitored, for example, over 24-96 hrs of incubation with peptidomimetic macrocycles (0.5 to 50 µM) to identify those that kill at $EC_{50}<10$ µM. Several standard assays that measure cell viability are commercially available and are optionally used to assess the efficacy of the peptidomimetic macrocycles. In addition, assays that measure Annexin V and caspase activation are optionally used to assess whether the peptidomimetic macrocycles kill cells by activating the apoptotic machinery. For example, the Cell Titer-glo assay is used which determines cell viability as a function of intracellular ATP concentration.

In Vivo Stability Assay.

To investigate the in vivo stability of the peptidomimetic macrocycles, the compounds are, for example, administered to mice and/or rats by IV, IP, PO or inhalation routes at concentrations ranging from 0.1 to 50 mg/kg and blood specimens withdrawn at 0', 5', 15', 30', 1 hr, 4 hrs, 8 hrs and 24 hours post-injection. Levels of intact compound in 25 µL of fresh serum are then measured by LC-MS/MS as above.

In Vivo Efficacy in Animal Models.

To determine the anti-oncogenic activity of peptidomimetic macrocycles in vivo, the compounds are, for example, given alone (IP, IV, PO, by inhalation or nasal routes) or in combination with sub-optimal doses of relevant chemotherapy (e.g., cyclophosphamide, doxorubicin, etoposide). In one example, $5\times10^6$ RS4; 11 cells (established from the bone marrow of a patient with acute lymphoblastic leukemia) that stably express luciferase are injected by tail vein in NOD-SCID mice 3 hrs after they have been subjected to total body irradiation. If left untreated, this form of leukemia is fatal in 3 weeks in this model. The leukemia is readily monitored, for example, by injecting the mice with D-luciferin (60 mg/kg) and imaging the anesthetized animals (e.g., Xenogen In Vivo Imaging System, Caliper Life Sciences, Hopkinton, Mass.). Total body bioluminescence is quantified by integration of photonic flux (photons/sec) by Living Image Software (Caliper Life Sciences, Hopkinton, Mass.). Peptidomimetic macrocycles alone or in combination with sub-optimal doses of relevant chemotherapeutics agents are, for example, administered to leukemic mice (10 days after injection/day 1 of experiment, in bioluminescence range of 14-16) by tail vein or IP routes at doses ranging from 0.1 mg/kg to 50 mg/kg for 7 to 21 days. Optionally, the mice are imaged throughout the experiment every other day and survival monitored daily for the duration of the experiment. Expired mice are optionally subjected to necropsy at the end of the experiment. Another animal model is implantation into NOD-SCID mice of DoHH2, a cell line derived from human follicular lymphoma, that stably expresses luciferase. These in vivo tests optionally generate preliminary pharmacokinetic, pharmacodynamic and toxicology data.

Clinical Trials.

To determine the suitability of the peptidomimetic macrocycles for treatment of humans, clinical trials are performed. For example, patients diagnosed with cancer and in need of treatment can be selected and separated in treatment and one or more control groups, wherein the treatment group is administered a peptidomimetic macrocycle, while the control groups receive a placebo or a known anti-cancer drug. The treatment safety and efficacy of the peptidomimetic macrocycles can thus be evaluated by performing comparisons of the patient groups with respect to factors such as survival and quality-of-life. In this example, the patient group treated with a peptidomimetic macrocycle can show improved long-term survival compared to a patient control group treated with a placebo.

Pharmaceutical Compositions and Routes of Administration

Pharmaceutical compositions disclosed herein include peptidomimetic macrocycles and pharmaceutically acceptable derivatives or prodrugs thereof. A "pharmaceutically acceptable derivative" means any pharmaceutically acceptable salt, ester, salt of an ester, pro-drug or other derivative of a compound disclosed herein which, upon administration to a recipient, is capable of providing (directly or indirectly) a compound disclosed herein. Particularly favored pharmaceutically acceptable derivatives are those that increase the bioavailability of the compounds when administered to a mammal (e.g., by increasing absorption into the blood of an orally administered compound) or which increases delivery of the active compound to a biological compartment (e.g., the brain or lymphatic system) relative to the parent species. Some pharmaceutically acceptable derivatives include a chemical group which increases aqueous solubility or active transport across the gastrointestinal mucosa.

In some embodiments, peptidomimetic macrocycles are modified by covalently or non-covalently joining appropriate functional groups to enhance selective biological properties. Such modifications include those which increase biological penetration into a given biological compartment (e.g., blood, lymphatic system, central nervous system), increase oral availability, increase solubility to allow administration by injection, alter metabolism, and alter rate of excretion.

Pharmaceutically acceptable salts of the compounds disclosed herein include those derived from pharmaceutically acceptable inorganic and organic acids and bases. Examples of suitable acid salts include acetate, adipate, benzoate, benzenesulfonate, butyrate, citrate, digluconate, dodecylsulfate, formate, fumarate, glycolate, hemisulfate, heptanoate, hexanoate, hydrochloride, hydrobromide, hydroiodide, lactate, maleate, malonate, methanesulfonate, 2-naphthalenesulfonate, nicotinate, nitrate, palmoate, phosphate, picrate, pivalate, propionate, salicylate, succinate, sulfate, tartrate, tosylate and undecanoate. Salts derived from appropriate bases include alkali metal (e.g., sodium), alkaline earth metal (e.g., magnesium), ammonium and $N\text{-}(alkyl)_4^+$ salts.

For preparing pharmaceutical compositions from the compounds disclosed herein, pharmaceutically acceptable carriers include either solid or liquid carriers. Solid form preparations include powders, tablets, pills, capsules, cachets, suppositories, and dispersible granules. A solid carrier can be one or more substances, which also acts as diluents, flavoring agents, binders, preservatives, tablet disintegrating agents, or an encapsulating material. Details on techniques for formulation and administration are well described in the scientific and patent literature, see, e.g., the latest edition of Remington's Pharmaceutical Sciences, Maack Publishing Co, Easton Pa.

In powders, the carrier is a finely divided solid, which is in a mixture with the finely divided active component. In tablets, the active component is mixed with the carrier having the necessary binding properties in suitable proportions and compacted in the shape and size desired.

Suitable solid excipients are carbohydrate or protein fillers include, but are not limited to sugars, including lactose, sucrose, mannitol, or sorbitol; starch from corn, wheat, rice, potato, or other plants; cellulose such as methyl cellulose, hydroxypropylmethyl-cellulose, or sodium carboxymethyl-cellulose; and gums including arabic and tragacanth; as well as proteins such as gelatin and collagen. If desired, disintegrating or solubilizing agents are added, such as the cross-linked polyvinyl pyrrolidone, agar, alginic acid, or a salt thereof, such as sodium alginate.

Liquid form preparations include solutions, suspensions, and emulsions, for example, water or water/propylene glycol solutions. For parenteral injection, liquid preparations can be formulated in solution in aqueous polyethylene glycol solution.

The pharmaceutical preparation can be in unit dosage form. In such form the preparation is subdivided into unit doses containing appropriate quantities of the active component. The unit dosage form can be a packaged preparation, the package containing discrete quantities of preparation, such as packeted tablets, capsules, and powders in vials or ampoules. Also, the unit dosage form can be a capsule, tablet, cachet, or lozenge itself, or it can be the appropriate number of any of these in packaged form.

When one or more compositions disclosed herein comprise a combination of a peptidomimetic macrocycle and one or more additional therapeutic or prophylactic agents, both the compound and the additional agent should be present at dosage levels of between about 1 to 100%, and more preferably between about 5 to 95% of the dosage normally administered in a monotherapy regimen. In some embodiments, the additional agents are administered separately, as part of a multiple dose regimen, from one or more compounds disclosed herein. Alternatively, those agents are part of a single dosage form, mixed together with the compounds disclosed herein in a single composition.

Methods of Use

In one aspect, provided herein are novel peptidomimetic macrocycles that are useful in competitive binding assays to identify agents which bind to the natural ligand(s) of the proteins or peptides upon which the peptidomimetic macrocycles are modeled. For example, in the p53/MDMX system, labeled peptidomimetic macrocycles based on p53 can be used in a MDMX binding assay along with small molecules that competitively bind to MDMX. Competitive binding studies allow for rapid in vitro evaluation and determination of drug candidates specific for the p53/MDMX system. Such binding studies can be performed with any of the peptidomimetic macrocycles disclosed herein and their binding partners.

Further provided are methods for the generation of antibodies against the peptidomimetic macrocycles. In some embodiments, these antibodies specifically bind both the peptidomimetic macrocycle and the precursor peptides, such as p53, to which the peptidomimetic macrocycles are related. Such antibodies, for example, disrupt the native protein-protein interaction, for example, binding between p53 and MDMX.

In other aspects, provided herein are both prophylactic and therapeutic methods of treating a subject at risk of (or susceptible to) a disorder or having a disorder associated with aberrant (e.g., insufficient or excessive) expression or activity of the molecules including p53, MDM2 or MDMX.

In another embodiment, a disorder is caused, at least in part, by an abnormal level of p53 or MDM2 or MDMX, (e.g., over or under expression), or by the presence of p53 or MDM2 or MDMX exhibiting abnormal activity. As such, the reduction in the level and/or activity of p53 or MDM2 or MDMX, or the enhancement of the level and/or activity of p53 or MDM2 or MDMX, by peptidomimetic macrocycles derived from p53, is used, for example, to ameliorate or reduce the adverse symptoms of the disorder.

In another aspect, provided herein are methods for treating or preventing a disease including hyperproliferative disease and inflammatory disorder by interfering with the interaction or binding between binding partners, for example, between p53 and MDM2 or p53 and MDMX. These methods comprise administering an effective amount of a compound to a warm blooded animal, including a human. In some embodiments, the administration of one or more compounds disclosed herein induces cell growth arrest or apoptosis.

As used herein, the term "treatment" is defined as the application or administration of a therapeutic agent to a patient, or application or administration of a therapeutic agent to an isolated tissue or cell line from a patient, who has a disease, a symptom of disease or a predisposition toward a disease, with the purpose to cure, heal, alleviate, relieve, alter, remedy, ameliorate, improve or affect the disease, the symptoms of disease or the predisposition toward disease.

In some embodiments, the peptidomimetic macrocycles can be used to treat, prevent, and/or diagnose cancers and neoplastic conditions. As used herein, the terms "cancer", "hyperproliferative" and "neoplastic" refer to cells having the capacity for autonomous growth, i.e., an abnormal state or condition characterized by rapidly proliferating cell growth. Hyperproliferative and neoplastic disease states can be categorized as pathologic, i.e., characterizing or constituting a disease state, or can be categorized as non-pathologic, i.e., a deviation from normal but not associated with a disease state. The term is meant to include all types of cancerous growths or oncogenic processes, metastatic tissues or malignantly transformed cells, tissues, or organs, irrespective of histopathologic type or stage of invasiveness. A metastatic tumor can arise from a multitude of primary tumor types, including but not limited to those of breast, lung, liver, colon and ovarian origin. "Pathologic hyperproliferative" cells occur in disease states characterized by malignant tumor growth. Examples of non-pathologic hyperproliferative cells include proliferation of cells associated with wound repair. Examples of cellular proliferative and/or differentiative disorders include cancer, e.g., carcinoma, sarcoma, or metastatic disorders. In some embodiments, the peptidomimetic macrocycles are novel therapeutic agents for controlling breast cancer, ovarian cancer, colon cancer, lung cancer, metastasis of such cancers and the like.

Examples of cancers or neoplastic conditions include, but are not limited to, a fibrosarcoma, myosarcoma, liposarcoma, chondrosarcoma, osteogenic sarcoma, chordoma, angiosarcoma, endotheliosarcoma, lymphangiosarcoma, lymphangioendotheliosarcoma, synovioma, mesothelioma, Ewing's tumor, leiomyosarcoma, rhabdomyosarcoma, gastric cancer, esophageal cancer, rectal cancer, pancreatic cancer, ovarian cancer, prostate cancer, uterine cancer, cancer of the head and neck, skin cancer, brain cancer, squamous cell carcinoma, sebaceous gland carcinoma, papillary carcinoma, papillary adenocarcinoma, cystadenocarcinoma, medullary carcinoma, bronchogenic carcinoma, renal cell carcinoma, hepatoma, bile duct carcinoma, choriocarcinoma, seminoma, embryonal carcinoma, Wilm's tumor, cervical cancer, testicular cancer, small cell lung carcinoma, non-small cell lung carcinoma, bladder carcinoma, epithelial carcinoma, glioma, astrocytoma, medulloblastoma, craniopharyngioma, ependymoma, pinealoma, hemangioblastoma, acoustic neuroma, oligodendroglioma, meningioma, melanoma, neuroblastoma, retinoblastoma, leukemia, lymphoma, or Kaposi sarcoma.

In some embodiments, the cancer is head and neck cancer, melanoma, lung cancer, breast cancer, or glioma.

Examples of proliferative disorders include hematopoietic neoplastic disorders. As used herein, the term "hematopoietic neoplastic disorders" includes diseases involving hyperplastic/neoplastic cells of hematopoietic origin, e.g., arising from myeloid, lymphoid or erythroid lineages, or precursor cells thereof. The diseases can arise from poorly differentiated acute leukemias, e.g., erythroblastic leukemia and acute megakaryoblastic leukemia. Additional exemplary myeloid disorders include, but are not limited to, acute promyeloid leukemia (APML), acute myelogenous leukemia (AML) and chronic myelogenous leukemia (CML) (reviewed in Vaickus (1991), *Crit Rev. Oncol./Hemotol.* 11:267-97); lymphoid malignancies include, but are not limited to acute lymphoblastic leukemia (ALL) which includes B-lineage ALL and T-lineage ALL, chronic lymphocytic leukemia (CLL), prolymphocytic leukemia (PLL), hairy cell leukemia (HLL) and Waldenstrom's macroglobulinemia (WM). Additional forms of malignant lymphomas include, but are not limited to non-Hodgkin lymphoma and variants thereof, peripheral T cell lymphomas, adult T cell leukemia/lymphoma (ATL), cutaneous T-cell lymphoma (CTCL), large granular lymphocytic leukemia (LGF), Hodgkin's disease and Reed-Stemberg disease.

Examples of cellular proliferative and/or differentiative disorders of the breast include, but are not limited to, proliferative breast disease including, e.g., epithelial hyperplasia, sclerosing adenosis, and small duct papillomas; tumors, e.g., stromal tumors such as fibroadenoma, phyllodes tumor, and sarcomas, and epithelial tumors such as large duct papilloma; carcinoma of the breast including in situ (noninvasive) carcinoma that includes ductal carcinoma in situ (including Paget's disease) and lobular carcinoma in situ, and invasive (infiltrating) carcinoma including, but not limited to, invasive ductal carcinoma, invasive lobular carcinoma, medullary carcinoma, colloid (mucinous) carcinoma, tubular carcinoma, and invasive papillary carcinoma, and miscellaneous malignant neoplasms. Disorders in the male breast include, but are not limited to, gynecomastia and carcinoma.

Examples of cellular proliferative and/or differentiative disorders of the skin include, but are not limited to proliferative skin disease such as melanomas, including mucosal melanoma, superficial spreading melanoma, nodular melanoma, lentigo (e.g. lentigo maligna, lentigo maligna melanoma, or acral lentiginous melanoma), amelanotic melanoma, desmoplastic melanoma, melanoma with features of a Spitz nevus, melanoma with small nevus-like cells, polypoid melanoma, and soft-tissue melanoma; basal cell carcinomas including micronodular basal cell carcinoma, superficial basal cell carcinoma, nodular basal cell carcinoma (rodent ulcer), cystic basal cell carcinoma, cicatricial basal cell carcinoma, pigmented basal cell carcinoma, aberrant basal cell carcinoma, infiltrative basal cell carcinoma, nevoid basal cell carcinoma syndrome, polypoid basal cell carcinoma, pore-like basal cell carcinoma, and fibroepithelioma of Pinkus; squamus cell carcinomas including acanthoma (large cell acanthoma), adenoid squamous cell carcinoma, basaloid squamous cell carcinoma, clear cell squamous cell carcinoma, signet-ring cell squamous cell carcinoma, spindle cell squamous cell carcinoma, Marjolin's ulcer, erythroplasia of Queyrat, and Bowen's disease; or other skin or subcutaneous tumors.

Examples of cellular proliferative and/or differentiative disorders of the lung include, but are not limited to, bronchogenic carcinoma, including paraneoplastic syndromes, bronchioloalveolar carcinoma, neuroendocrine tumors, such as bronchial carcinoid, miscellaneous tumors, and metastatic tumors; pathologies of the pleura, including inflammatory pleural effusions, noninflammatory pleural effusions, pneumothorax, and pleural tumors, including solitary fibrous tumors (pleural fibroma) and malignant mesothelioma.

Examples of cellular proliferative and/or differentiative disorders of the colon include, but are not limited to, non-neoplastic polyps, adenomas, familial syndromes, colorectal carcinogenesis, colorectal carcinoma, and carcinoid tumors.

Examples of cellular proliferative and/or differentiative disorders of the liver include, but are not limited to, nodular hyperplasias, adenomas, and malignant tumors, including primary carcinoma of the liver and metastatic tumors.

Examples of cellular proliferative and/or differentiative disorders of the ovary include, but are not limited to, ovarian tumors such as, tumors of coelomic epithelium, serous tumors, mucinous tumors, endometrioid tumors, clear cell adenocarcinoma, cystadenofibroma, Brenner tumor, surface epithelial tumors; germ cell tumors such as mature (benign) teratomas, monodermal teratomas, immature malignant teratomas, dysgerminoma, endodermal sinus tumor, choriocarcinoma; sex cord-stomal tumors such as, granulosa-theca cell tumors, thecomafibromas, androblastomas, hill cell tumors, and gonadoblastoma; and metastatic tumors such as Krukenberg tumors.

While preferred embodiments of the present invention have been shown and described herein, it will be obvious to those skilled in the art that such embodiments are provided by way of example only. Numerous variations, changes, and substitutions will now occur to those skilled in the art without departing from the invention. It should be understood that various alternatives to the embodiments described herein can be employed in practicing the invention. It is intended that the following claims define the scope and that methods and structures within the scope of these claims and their equivalents be covered thereby.

EXAMPLES

Example 1

Synthesis of 6-Chlorotryptophan Fmoc Amino Acids

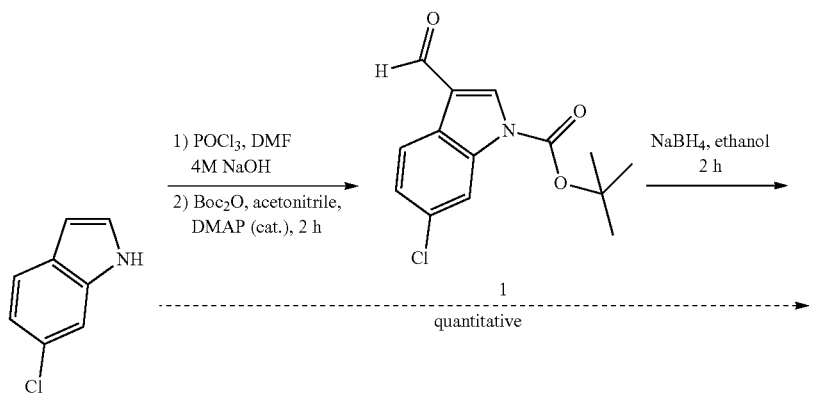

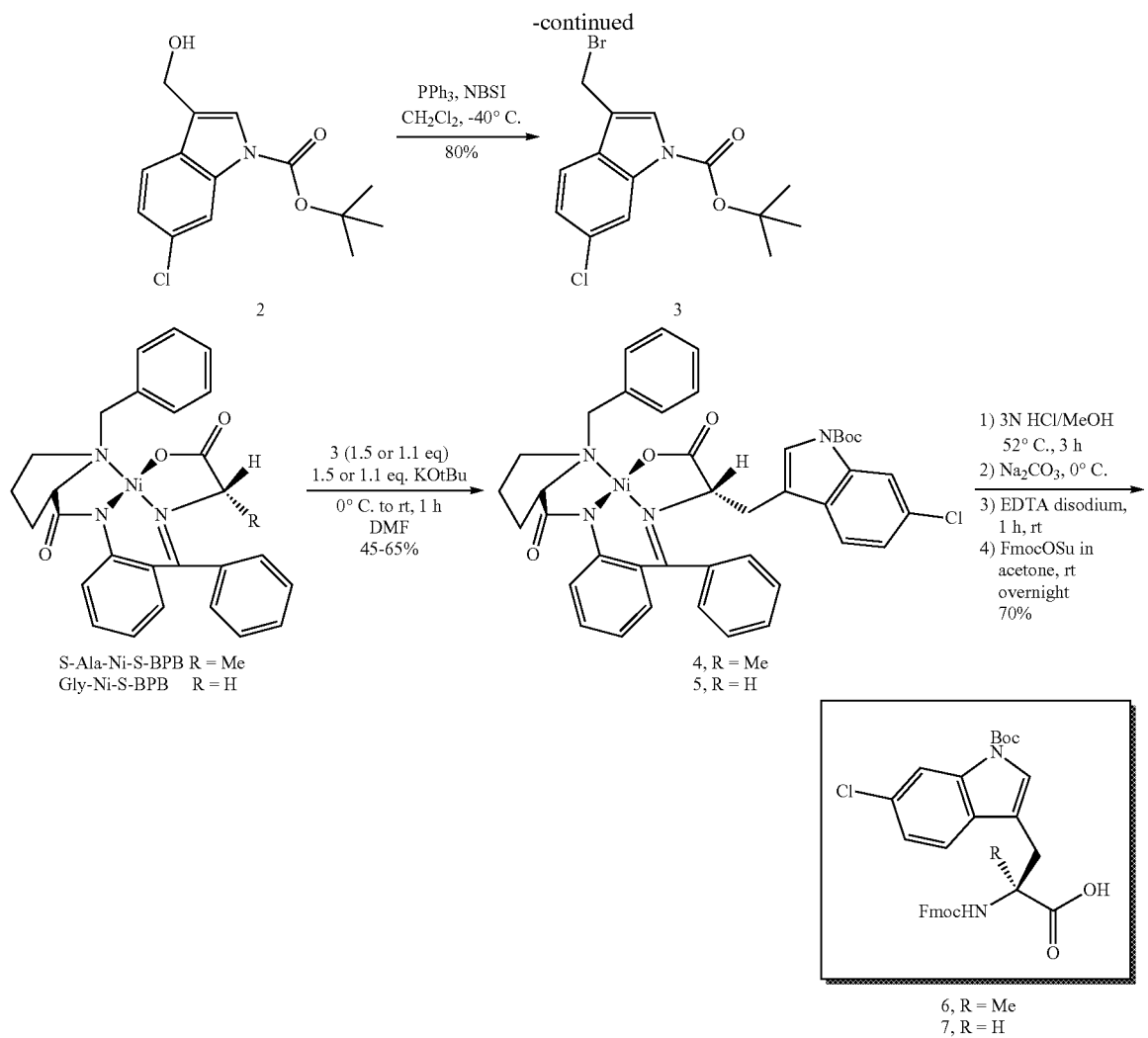

6, R = Me
7, R = H

Tert-butyl 6-chloro-3-formyl-1H-indole-1-carboxylate, 1. To a stirred solution of dry DMF (12 mL) was added dropwise POCl₃ (3.92 mL, 43 mmol, 1.3 equiv) at 0° C. under Argon. The solution was stirred at the same temperature for 20 min before a solution of 6-chloroindole (5.0 g, 33 mmol, 1 eq.) in dry DMF (30 mL) was added dropwise. The resulting mixture was allowed to warm to room temperature and stirred for an additional 2.5 h. Water (50 mL) was added and the solution was neutralized with 4M aqueous NaOH (pH ~8). The resulting solid was filtered off, washed with water and dried under vacuum. This material was directly used in the next step without additional purification. To a stirred solution of the crude formyl indole (33 mmol, 1 eq.) in THF (150 mL) was added successively Boc₂O (7.91 g, 36.3 mmol, 1.1 equiv) and DMAP (0.4 g, 3.3 mmol, 0.1 equiv) at room temperature under N₂. The resulting mixture was stirred at room temperature for 1.5 h and the solvent was evaporated under reduced pressure. The residue was taken up in EtOAc and washed with 1N HCl, dried and concentrated to give the formyl indole 1 (9 g, 98% over 2 steps) as a white solid. $^1$H NMR (CDCl₃) δ: 1.70 (s, Boc, 9H); 7.35 (dd, 1H); 8.21 (m, 3H); 10.07 (s, 1H).

Tert-butyl 6-chloro-3-(hydroxymethyl)-1H-indole-1-carboxylate, 2. To a solution of compound 1 (8.86 g, 32 mmol, 1 eq.) in ethanol (150 mL) was added NaBH₄ (2.4 g, 63 mmol, 2 eq.). The reaction was stirred for 3 h at room temperature. The reaction mixture was concentrated and the residue was poured into diethyl ether and water. The organic layer was separated, dried over magnesium sulfate and concentrated to give a white solid (8.7 g, 98%). This material was directly used in the next step without additional purification. $^1$H NMR (CDCl₃) δ: 1.65 (s, Boc, 9H); 4.80 (s, 2H, CH₂); 7.21 (dd, 1H); 7.53 (m, 2H); 8.16 (bs, 1H).

Tert-butyl 3-(bromomethyl)-6-chloro-1H-indole-1-carboxylate, 3. To a solution of compound 2 (4.1 g, 14.6 mmol, 1 eq.) in dichloromethane (50 mL) under argon was added a solution of triphenylphosphine (4.59 g, 17.5 mmol, 1.2 eq.) in dichloromethane (50 mL) at −40° C. The reaction solution was stirred an additional 30 min at 40° C. Then NBS (3.38 g, 19 mmol, 1.3 eq.) was added. The resulting mixture was allowed to warm to room temperature and stirred overnight. Dichloromethane was evaporated, Carbon Tetrachloride (100 mL) was added and the mixture was stirred for 1 h and filtrated. The filtrate was concentrated, loaded in a silica plug and quickly eluted with 25% EtOAc in Hexanes. The solution was concentrated to give a white foam (3.84 g, 77%). $^1$H NMR (CDCl₃) δ: 1.66 (s, Boc, 9H); 4.63 (s, 2H, CH₂); 7.28 (dd, 1H); 7.57 (d, 1H); 7.64 (bs, 1H); 8.18 (bs, 1H).

αMe-6Cl-Trp(Boc)-Ni-S-BPB, 4. To S-Ala-Ni-S-BPB (2.66 g, 5.2 mmol, 1 eq.) and KO-tBu (0.87 g, 7.8 mmol, 1.5 eq.) was added 50 mL of DMF under argon. The bromide derivative compound 3 (2.68 g, 7.8 mmol, 1.5 eq.) in solution of DMF (5.0 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 4 was purified by flash chromatography (solid loading) on normal phase using EtOAc and Hexanes as eluents to give a red solid (1.78 g, 45% yield). αMe-6Cl-Trp(Boc)-Ni-S-BPB, 4: M+H calc. 775.21, M+H obs. 775.26; $^1$H NMR (CDCl$_3$) δ: 1.23 (s, 3H, αMe); 1.56 (m, 11H, Boc+CH$_2$); 1.82-2.20 (m, 4H, 2CH$_2$); 3.03 (m, 1H, CH$_α$); 3.24 (m, 2H, CH$_2$); 3.57 and 4.29 (AB system, 2H, CH$_2$ (benzyl), J=12.8 Hz); 6.62 (d, 2H); 6.98 (d, 1H); 7.14 (m, 2H); 7.23 (m, 1H); 7.32-7.36 (m, 5H); 7.50 (m, 2H); 7.67 (bs, 1H); 7.98 (d, 2H); 8.27 (m, 2H).

Fmoc-αMe-6Cl-Trp(Boc)-OH, 6. To a solution of 3N HCl/MeOH (⅓, 15 mL) at 50° C. was added a solution of compound 4 (1.75 g, 2.3 mmol, 1 eq.) in MeOH (5 ml) dropwise. The starting material disappeared within 3-4 h. The acidic solution was then cooled to 0° C. with an ice bath and quenched with an aqueous solution of Na$_2$CO$_3$ (1.21 g, 11.5 mmol, 5 eq.). Methanol was removed and 8 more equivalents of Na$_2$CO$_3$ (1.95 g, 18.4 mmol) were added to the suspension. The Nickel scavenging EDTA disodium salt dihydrate (1.68 g, 4.5 mmol, 2 eq.) was then added and the suspension was stirred for 2 h. A solution of Fmoc-OSu (0.84 g, 2.5 mmol, 1.1 eq.) in acetone (50 mL) was added and the reaction was stirred overnight. Afterwards, the reaction was diluted with diethyl ether and 1N HCl. The organic layer was then dried over magnesium sulfate and concentrated in vacuo. The desired product 6 was purified on normal phase using acetone and dichloromethane as eluents to give a white foam (0.9 g, 70% yield). Fmoc-αMe-6Cl-Trp(Boc)-OH, 6: M+H calc. 575.19, M+H obs. 575.37; $^1$H NMR (CDCl$_3$) 1.59 (s, 9H, Boc); 1.68 (s, 3H, Me); 3.48 (bs, 2H, CH$_2$); 4.22 (m, 1H, CH); 4.39 (bs, 2H, CH$_2$); 5.47 (s, 1H, NH); 7.10 (m, 1H); 7.18 (m, 2H); 7.27 (m, 2H); 7.39 (m, 2H); 7.50 (m, 2H); 7.75 (d, 2H); 8.12 (bs, 1H).

6Cl-Trp(Boc)-Ni-S-BPB, 5. To Gly-Ni-S-BPB (4.6 g, 9.2 mmol, 1 eq.) and KO-tBu (1.14 g, 10.1 mmol, 1.1 eq.) was added 95 mL of DMF under argon. The bromide derivative compound 3 (3.5 g, 4.6 mmol, 1.1 eq.) in solution of DMF (10 mL) was added via syringe. The reaction mixture was stirred at ambient temperature for 1 h. The solution was then quenched with 5% aqueous acetic acid and diluted with water. The desired product was extracted in dichloromethane, dried and concentrated. The oily product 5 was purified by flash chromatography (solid loading) on normal phase using EtOAc and Hexanes as eluents to give a red solid (5 g, 71% yield). 6CL-Trp(Boc)-Ni-S-BPB, 5: M+H calc. 761.20, M+H obs. 761.34; $^1$H NMR (CDCl$_3$) δ: 1.58 (m, 11H, Boc+CH$_2$); 1.84 (m, 1H); 1.96 (m, 1H); 2.24 (m, 2H, CH$_2$); 3.00 (m, 1H, CH$_α$); 3.22 (m, 2H, CH$_2$); 3.45 and 4.25 (AB system, 2H, CH$_2$ (benzyl), J=12.8 Hz); 4.27 (m, 1H, CH$_α$); 6.65 (d, 2H); 6.88 (d, 1H); 7.07 (m, 2H); 7.14 (m, 2H); 7.28 (m, 3H); 7.35-7.39 (m, 2H); 7.52 (m, 2H); 7.96 (d, 2H); 8.28 (m, 2H).

Fmoc-6CL-Trp(Boc)-OH, 7. To a solution of 3N HCl/MeOH (⅓, 44 mL) at 50° C. was added a solution of compound 5 (5 g, 6.6 mmol, 1 eq.) in MeOH (10 ml) dropwise. The starting material disappeared within 3-4 h. The acidic solution was then cooled to 0° C. with an ice bath and quenched with an aqueous solution of Na$_2$CO$_3$ (3.48 g, 33 mmol, 5 eq.). Methanol was removed and 8 more equivalents of Na$_2$CO$_3$ (5.57 g, 52 mmol) were added to the suspension. The Nickel scavenging EDTA disodium salt dihydrate (4.89 g, 13.1 mmol, 2 eq.) and the suspension was stirred for 2 h. A solution of Fmoc-OSu (2.21 g, 6.55 mmol, 1.1 eq.) in acetone (100 mL) was added and the reaction was stirred overnight. Afterwards, the reaction was diluted with diethyl ether and 1N HCl. The organic layer was then dried over magnesium sulfate and concentrated in vacuo. The desired product 7 was purified on normal phase using acetone and dichloromethane as eluents to give a white foam (2.6 g, 69% yield). Fmoc-6Cl-Trp(Boc)-OH, 7: M+H calc. 561.17, M+H obs. 561.37; $^1$H NMR (CDCl$_3$) 1.63 (s, 9H, Boc); 3.26 (m, 2H, CH$_2$); 4.19 (m, 1H, CH); 4.39 (m, 2H, CH$_2$); 4.76 (m, 1H); 5.35 (d, 1H, NH); 7.18 (m, 2H); 7.28 (m, 2H); 7.39 (m, 3H); 7.50 (m, 2H); 7.75 (d, 2H); 8.14 (bs, 1H).

Example 2

Peptidomimetic Macrocycles

Peptidomimetic macrocycles were synthesized, purified and analyzed as previously described and as described below (Schafmeister et al., J. Am. Chem. Soc. 122:5891-5892 (2000); Schafmeister & Verdine, J. Am. Chem. Soc. 122:5891 (2005); Walensky et al., Science 305:1466-1470 (2004); and U.S. Pat. No. 7,192,713). Peptidomimetic macrocycles were designed by replacing two or more naturally occurring amino acids with the corresponding synthetic amino acids. Substitutions were made at i and i+4, and i and i+7 positions. Peptide synthesis was performed either manually or on an automated peptide synthesizer (Applied Biosystems, model 433A), using solid phase conditions, rink amide AM resin (Novabiochem), and Fmoc main-chain protecting group chemistry. For the coupling of natural Fmoc-protected amino acids (Novabiochem), 10 equivalents of amino acid and a 1:1:2 molar ratio of coupling reagents HBTU/HOBt (Novabiochem)/DIEA were employed. Non-natural amino acids (4 equiv) were coupled with a 1:1:2 molar ratio of HATU (Applied Biosystems)/HOBt/DIEA. The N-termini of the synthetic peptides were acetylated, while the C-termini were amidated.

Purification of cross-linked compounds was achieved by high performance liquid chromatography (HPLC) (Varian ProStar) on a reverse phase C18 column (Varian) to yield the pure compounds. Chemical composition of the pure products was confirmed by LC/MS mass spectrometry (Micromass LCT interfaced with Agilent 1100 HPLC system) and amino acid analysis (Applied Biosystems, model 420A).

The following protocol was used in the synthesis of dialkyne-crosslinked peptidomimetic macrocycles, including SP662, SP663 and SP664. Fully protected resin-bound peptides were synthesized on a PEG-PS resin (loading 0.45 mmol/g) on a 0.2 mmol scale. Deprotection of the temporary Fmoc group was achieved by 3×10 min treatments of the resin bound peptide with 20% (v/v) piperidine in DMF. After washing with NMP (3×), dichloromethane (3×) and NMP (3×), coupling of each successive amino acid was achieved with 1×60 min incubation with the appropriate preactivated Fmoc-amino acid derivative. All protected amino acids (0.4 mmol) were dissolved in NMP and activated with HCTU (0.4 mmol) and DIEA (0.8 mmol) prior to transfer of the coupling solution to the deprotected resin-bound peptide. After coupling was completed, the resin was washed in preparation for the next deprotection/coupling cycle. Acetylation of the amino terminus was carried out in the presence of acetic anhydride/DIEA in NMP. The LC-MS analysis of a cleaved and deprotected sample obtained from an aliquot of the fully assembled resin-bound peptide was accomplished in order to verifying the completion of each coupling. In a typical example, tetrahydrofuran (4 ml) and triethylamine (2 ml) were added to the peptide resin (0.2 mmol) in a 40 ml glass vial and shaken for 10 minutes. Pd(PPh$_3$)$_2$Cl$_2$ (0.014 g, 0.02 mmol) and copper iodide (0.008 g, 0.04 mmol) were then added and the resulting reaction mixture was mechanically shaken 16 hours while open to atmosphere. The diyne-cyclized resin-bound peptides were deprotected and cleaved from the solid support by treatment with TFA/H$_2$O/TIS (95/5/5 v/v) for 2.5 h at room temperature. After filtration of the resin the TFA solution was precipitated in cold diethyl ether and centrifuged to yield the desired product as a solid. The crude product was purified by preparative HPLC.

The following protocol was used in the synthesis of single alkyne-crosslinked peptidomimetic macrocycles, including SP665. Fully protected resin-bound peptides were synthesized on a Rink amide MBHA resin (loading 0.62 mmol/g) on a 0.1 mmol scale. Deprotection of the temporary Fmoc group was achieved by 2×20 min treatments of the resin bound peptide with 25% (v/v) piperidine in NMP. After extensive flow washing with NMP and dichloromethane, coupling of each successive amino acid was achieved with 1×60 min incubation with the appropriate preactivated Fmoc-amino acid derivative. All protected amino acids (1 mmol) were dissolved in NMP and activated with HCTU (1 mmol) and DIEA (1 mmol) prior to transfer of the coupling solution to the deprotected resin-bound peptide. After coupling was completed, the resin was extensively flow washed in preparation for the next deprotection/coupling cycle. Acetylation of the amino terminus was carried out in the presence of acetic anhydride/DIEA in NMP/NMM. The LC-MS analysis of a cleaved and deprotected sample obtained from an aliquot of the fully assembled resin-bound peptide was accomplished in order to verifying the completion of each coupling. In a typical example, the peptide resin (0.1 mmol) was washed with DCM. Resin was loaded into a microwave vial. The vessel was evacuated and purged with nitrogen. Molybdenumhexacarbonyl (0.01 eq, Sigma Aldrich 199959) was added. Anhydrous chlorobenzene was added to the reaction vessel. Then 2-fluorophenol (1 eq, Sigma Aldrich F12804) was added. The reaction was then loaded into the microwave and held at 130° C. for 10 minutes. Reaction may need to be pushed a subsequent time for completion. The alkyne metathesized resin-bound peptides were deprotected and cleaved from the solid support by treatment with TFA/H$_2$O/TIS (94/3/3 v/v) for 3 h at room temperature. After filtration of the resin the TFA solution was precipitated in cold diethyl ether and centrifuged to yield the desired product as a solid. The crude product was purified by preparative HPLC.

Table 1 shows a list of peptidomimetic macrocycles prepared.

TABLE 1

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP1 | Ac-F$r8AYWEAc3cL$AAA-NH2 | 10 | | 1456.78 | 729.44 | 1457.79 | 729.4 | 486.6 |
| SP2 | Ac-F$r8AYWEAc3cL$AAibA-NH2 | 11 | | 1470.79 | 736.4 | 1471.8 | 736.4 | 491.27 |
| SP3 | Ac-LTF$r8AYWAQL$SANle-NH2 | 12 | | 1715.97 | 859.02 | 1716.98 | 858.99 | 573 |
| SP4 | Ac-LTF$r8AYWAQL$SAL-NH2 | 13 | | 1715.97 | 859.02 | 1716.98 | 858.99 | 573 |
| SP5 | Ac-LTF$r8AYWAQL$SAM-NH2 | 14 | | 1733.92 | 868.48 | 1734.93 | 867.97 | 578.98 |
| SP6 | Ac-LTF$r8AYWAQL$SAhL-NH2 | 15 | | 1729.98 | 865.98 | 1730.99 | 866 | 577.67 |
| SP7 | Ac-LTF$r8AYWAQL$SAF-NH2 | 16 | | 1749.95 | 876.36 | 1750.96 | 875.98 | 584.32 |
| SP8 | Ac-LTF$r8AYWAQL$SAI-NH2 | 17 | | 1715.97 | 859.02 | 1716.98 | 858.99 | 573 |
| SP9 | Ac-LTF$r8AYWAQL$SAChg-NH2 | 18 | | 1741.98 | 871.98 | 1742.99 | 872 | 581.67 |
| SP10 | Ac-LTF$r8AYWAQL$SAAib-NH2 | 19 | | 1687.93 | 845.36 | 1688.94 | 844.97 | 563.65 |
| SP11 | Ac-LTF$r8AYWAQL$SAA-NH2 | 20 | | 1673.92 | 838.01 | 1674.93 | 837.97 | 558.98 |
| SP12 | Ac-LTF$r8AYWA$L$S$Nle-NH2 | 21 | | 1767.04 | 884.77 | 1768.05 | 884.53 | 590.02 |
| SP13 | Ac-LTF$r8AYWA$L$S$A-NH2 | 22 | | 1724.99 | 864.23 | 1726 | 863.5 | 576 |
| SP14 | Ac-F$r8AYWEAc3cL$AANle-NH2 | 23 | | 1498.82 | 750.46 | 1499.83 | 750.42 | 500.61 |
| SP15 | Ac-F$r8AYWEAc3cL$AAL-NH2 | 24 | | 1498.82 | 750.46 | 1499.83 | 750.42 | 500.61 |
| SP16 | Ac-F$r8AYWEAc3cL$AAM-NH2 | 25 | | 1516.78 | 759.41 | 1517.79 | 759.4 | 506.6 |
| SP17 | Ac-F$r8AYWEAc3cL$AAhL-NH2 | 26 | | 1512.84 | 757.49 | 1513.85 | 757.43 | 505.29 |
| SP18 | Ac-F$r8AYWEAc3cL$AAF-NH2 | 27 | | 1532.81 | 767.48 | 1533.82 | 767.41 | 511.94 |
| SP19 | Ac-F$r8AYWEAc3cL$AAI-NH2 | 28 | | 1498.82 | 750.39 | 1499.83 | 750.42 | 500.61 |
| SP20 | Ac-F$r8AYWEAc3cL$AAChg-NH2 | 29 | | 1524.84 | 763.48 | 1525.85 | 763.43 | 509.29 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP21 | Ac-F$r8AYWEAc3cL$AACha-NH2 | 30 | | 1538.85 | 770.44 | 1539.86 | 770.43 | 513.96 |
| SP22 | Ac-F$r8AYWEAc3cL$AAAib-NH2 | 31 | | 1470.79 | 736.84 | 1471.8 | 736.4 | 491.27 |
| SP23 | Ac-LTF$r8AYWAQL$AAAibV-NH2 | 32 | | 1771.01 | 885.81 | 1772.02 | 886.51 | 591.34 |
| SP24 | Ac-LTF$r8AYWAQL$AAAibV-NH2 | 33 | iso2 | 1771.01 | 886.26 | 1772.02 | 886.51 | 591.34 |
| SP25 | Ac-LTF$r8AYWAQL$SAibAA-NH2 | 34 | | 1758.97 | 879.89 | 1759.98 | 880.49 | 587.33 |
| SP26 | Ac-LTF$r8AYWAQL$SAibAA-NH2 | 35 | iso2 | 1758.97 | 880.34 | 1759.98 | 880.49 | 587.33 |
| SP27 | Ac-HLTF$r8HHWHQL$AANleNle-NH2 | 36 | | 2056.15 | 1028.86 | 2057.16 | 1029.08 | 686.39 |
| SP28 | Ac-DLTF$r8HHWHQL$RRLV-NH2 | 37 | | 2190.23 | 731.15 | 2191.24 | 1096.12 | 731.08 |
| SP29 | Ac-HHTF$r8HHWHQL$AAML-NH2 | 38 | | 2098.08 | 700.43 | 2099.09 | 1050.05 | 700.37 |
| SP30 | Ac-F$r8HHWHQL$RRDCha-NH2 | 39 | | 1917.06 | 959.96 | 1918.07 | 959.54 | 640.03 |
| SP31 | Ac-F$r8HHWHQL$HRFV-NH2 | 40 | | 1876.02 | 938.65 | 1877.03 | 939.02 | 626.35 |
| SP32 | Ac-HLTF$r8HHWHQL$AAhLA-NH2 | 41 | | 2028.12 | 677.2 | 2029.13 | 1015.07 | 677.05 |
| SP33 | Ac-DLTF$r8HHWHQL$RRChgl-NH2 | 42 | | 2230.26 | 1115.89 | 2231.27 | 1116.14 | 744.43 |
| SP34 | Ac-DLTF$r8HHWHQL$RRChgl-NH2 | 43 | iso2 | 2230.26 | 1115.96 | 2231.27 | 1116.14 | 744.43 |
| SP35 | Ac-HHTF$r8HHWHQL$AAChav-NH2 | 44 | | 2106.14 | 1053.95 | 2107.15 | 1054.08 | 703.05 |
| SP36 | Ac-F$r8HHWHQL$RRDa-NH2 | 45 | | 1834.99 | 918.3 | 1836 | 918.5 | 612.67 |
| SP37 | Ac-F$r8HHWHQL$HRAibG-NH2 | 46 | | 1771.95 | 886.77 | 1772.96 | 886.98 | 591.66 |
| SP38 | Ac-F$r8AYWAQL$HHNleL-NH2 | 47 | | 1730.97 | 866.57 | 1731.98 | 866.49 | 578 |
| SP39 | Ac-F$r8AYWSAL$HQANle-NH2 | 48 | | 1638.89 | 820.54 | 1639.9 | 820.45 | 547.3 |
| SP40 | Ac-F$r8AYWVQL$QHChgl-NH2 | 49 | | 1776.01 | 889.44 | 1777.02 | 889.01 | 593.01 |
| SP41 | Ac-F$r8AYWTAL$QQNlev-NH2 | 50 | | 1671.94 | 836.97 | 1672.95 | 836.98 | 558.32 |
| SP42 | Ac-F$r8AYWYQL$HAibAa-NH2 | 51 | | 1686.89 | 844.52 | 1687.9 | 844.45 | 563.3 |
| SP43 | Ac-LTF$r8AYWAQL$HHLa-NH2 | 52 | | 1903.05 | 952.27 | 1904.06 | 952.53 | 635.36 |
| SP44 | Ac-LTF$r8AYWAQL$HHLa-NH2 | 53 | iso2 | 1903.05 | 952.27 | 1904.06 | 952.53 | 635.36 |
| SP45 | Ac-LTF$r8AYWAQL$HQNlev-NH2 | 54 | | 1922.08 | 962.48 | 1923.09 | 962.05 | 641.7 |
| SP46 | Ac-LTF$r8AYWAQL$HQNlev-NH2 | 55 | iso2 | 1922.08 | 962.4 | 1923.09 | 962.05 | 641.7 |
| SP47 | Ac-LTF$r8AYWAQL$QQml-NH2 | 56 | | 1945.05 | 973.95 | 1946.06 | 973.53 | 649.36 |
| SP48 | Ac-LTF$r8AYWAQL$QQml-NH2 | 57 | iso2 | 1945.05 | 973.88 | 1946.06 | 973.53 | 649.36 |
| SP49 | Ac-LTF$r8AYWAQL$HAibhLV-NH2 | 58 | | 1893.09 | 948.31 | 1894.1 | 947.55 | 632.04 |
| SP50 | Ac-LTF$r8AYWAQL$AHFA-NH2 | 59 | | 1871.01 | 937.4 | 1872.02 | 936.51 | 624.68 |
| SP51 | Ac-HLTF$r8HHWHQL$AANlel-NH2 | 60 | | 2056.15 | 1028.79 | 2057.16 | 1029.08 | 686.39 |
| SP52 | Ac-DLTF$r8HHWHQL$RRLa-NH2 | 61 | | 2162.2 | 721.82 | 2163.21 | 1082.11 | 721.74 |
| SP53 | Ac-HHTF$r8HHWHQL$AAMv-NH2 | 62 | | 2084.07 | 1042.92 | 2085.08 | 1043.04 | 695.7 |
| SP54 | Ac-F$r8HHWHQL$RRDA-NH2 | 63 | | 1834.99 | 612.74 | 1836 | 918.5 | 612.67 |
| SP55 | Ac-F$r8HHWHQL$HRFCha-NH2 | 64 | | 1930.06 | 966.47 | 1931.07 | 966.04 | 644.36 |
| SP56 | Ac-F$r8AYWEAL$AA-NHAm | 65 | | 1443.82 | 1445.71 | 1444.83 | 722.92 | 482.28 |
| SP57 | Ac-F$r8AYWEAL$AA-NHiAm | 66 | | 1443.82 | 723.13 | 1444.83 | 722.92 | 482.28 |
| SP58 | Ac-F$r8AYWEAL$AA-NHnPr3Ph | 67 | | 1491.82 | 747.3 | 1492.83 | 746.92 | 498.28 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP59 | Ac-F$r8AYWEAL$AA-NHnBu33Me | 68 | | 1457.83 | 1458.94 | 1458.84 | 729.92 | 486.95 |
| SP60 | Ac-F$r8AYWEAL$AA-NHnPr | 69 | | 1415.79 | 709.28 | 1416.8 | 708.9 | 472.94 |
| SP61 | Ac-F$r8AYWEAL$AA-NHnEt2Ch | 70 | | 1483.85 | 1485.77 | 1484.86 | 742.93 | 495.62 |
| SP62 | Ac-F$r8AYWEAL$AA-NHnEt2Cp | 71 | | 1469.83 | 1470.78 | 1470.84 | 735.92 | 490.95 |
| SP63 | Ac-F$r8AYWEAL$AA-NHHex | 72 | | 1457.83 | 730.19 | 1458.84 | 729.92 | 486.95 |
| SP64 | Ac-LTF$r8AYWAQL$AAIA-NH2 | 73 | | 1771.01 | 885.81 | 1772.02 | 886.51 | 591.34 |
| SP65 | Ac-LTF$r8AYWAQL$AAIA-NH2 | 74 | iso2 | 1771.01 | 866.8 | 1772.02 | 886.51 | 591.34 |
| SP66 | Ac-LTF$r8AYWAAL$AAMA-NH2 | 75 | | 1731.94 | 867.08 | 1732.95 | 866.98 | 578.32 |
| SP67 | Ac-LTF$r8AYWAAL$AAMA-NH2 | 76 | iso2 | 1731.94 | 867.28 | 1732.95 | 866.98 | 578.32 |
| SP68 | Ac-LTF$r8AYWAQL$AANleA-NH2 | 77 | | 1771.01 | 867.1 | 1772.02 | 886.51 | 591.34 |
| SP69 | Ac-LTF$r8AYWAQL$AANleA-NH2 | 78 | iso2 | 1771.01 | 886.89 | 1772.02 | 886.51 | 591.34 |
| SP70 | Ac-LTF$r8AYWAQL$AAIa-NH2 | 79 | | 1771.01 | 886.8 | 1772.02 | 886.51 | 591.34 |
| SP71 | Ac-LTF$r8AYWAQL$AAIa-NH2 | 80 | iso2 | 1771.01 | 887.09 | 1772.02 | 886.51 | 591.34 |
| SP72 | Ac-LTF$r8AYWAAL$AAMa-NH2 | 81 | | 1731.94 | 867.17 | 1732.95 | 866.98 | 578.32 |
| SP73 | Ac-LTF$r8AYWAAL$AAMa-NH2 | 82 | iso2 | 1731.94 | 867.37 | 1732.95 | 866.98 | 578.32 |
| SP74 | Ac-LTF$r8AYWAQL$AANlea-NH2 | 83 | | 1771.01 | 887.08 | 1772.02 | 886.51 | 591.34 |
| SP75 | Ac-LTF$r8AYWAQL$AANlea-NH2 | 84 | iso2 | 1771.01 | 887.08 | 1772.02 | 886.51 | 591.34 |
| SP76 | Ac-LTF$r8AYWAAL$AAIv-NH2 | 85 | | 1742.02 | 872.37 | 1743.03 | 872.02 | 581.68 |
| SP77 | Ac-LTF$r8AYWAAL$AAIv-NH2 | 86 | iso2 | 1742.02 | 872.74 | 1743.03 | 872.02 | 581.68 |
| SP78 | Ac-LTF$r8AYWAQL$AAMv-NH2 | 87 | | 1817 | 910.02 | 1818.01 | 909.51 | 606.67 |
| SP79 | Ac-LTF$r8AYWAAL$AANlev-NH2 | 88 | | 1742.02 | 872.37 | 1743.03 | 872.02 | 581.68 |
| SP80 | Ac-LTF$r8AYWAAL$AANlev-NH2 | 89 | iso2 | 1742.02 | 872.28 | 1743.03 | 872.02 | 581.68 |
| SP81 | Ac-LTF$r8AYWAQL$AAIl-NH2 | 90 | | 1813.05 | 907.81 | 1814.06 | 907.53 | 605.36 |
| SP82 | Ac-LTF$r8AYWAQL$AAIl-NH2 | 91 | iso2 | 1813.05 | 907.81 | 1814.06 | 907.53 | 605.36 |
| SP83 | Ac-LTF$r8AYWAAL$AAMl-NH2 | 92 | | 1773.99 | 887.37 | 1775 | 888 | 592.34 |
| SP84 | Ac-LTF$r8AYWAQL$AANlel-NH2 | 93 | | 1813.05 | 907.61 | 1814.06 | 907.53 | 605.36 |
| SP85 | Ac-LTF$r8AYWAQL$AANlel-NH2 | 94 | iso2 | 1813.05 | 907.71 | 1814.06 | 907.53 | 605.36 |
| SP86 | Ac-F$r8AYWEAL$AAMA-NH2 | 95 | | 1575.82 | 789.02 | 1576.83 | 788.92 | 526.28 |
| SP87 | Ac-F$r8AYWEAL$AANleA-NH2 | 96 | | 1557.86 | 780.14 | 1558.87 | 779.94 | 520.29 |
| SP88 | Ac-F$r8AYWEAL$AAIa-NH2 | 97 | | 1557.86 | 780.33 | 1558.87 | 779.94 | 520.29 |
| SP89 | Ac-F$r8AYWEAL$AAMa-NH2 | 98 | | 1575.82 | 789.3 | 1576.83 | 788.92 | 526.28 |
| SP90 | Ac-F$r8AYWEAL$AANlea-NH2 | 99 | | 1557.86 | 779.4 | 1558.87 | 779.94 | 520.29 |
| SP91 | Ac-F$r8AYWEAL$AAIv-NH2 | 100 | | 1585.89 | 794.29 | 1586.9 | 793.95 | 529.64 |
| SP92 | Ac-F$r8AYWEAL$AAMv-NH2 | 101 | | 1603.85 | 803.08 | 1604.86 | 802.93 | 535.62 |
| SP93 | Ac-F$r8AYWEAL$AANlev-NH2 | 102 | | 1585.89 | 793.46 | 1586.9 | 793.95 | 529.64 |
| SP94 | Ac-F$r8AYWEAL$AAIl-NH2 | 103 | | 1599.91 | 800.49 | 1600.92 | 800.96 | 534.31 |
| SP95 | Ac-F$r8AYWEAL$AAMl-NH2 | 104 | | 1617.86 | 809.44 | 1618.87 | 809.94 | 540.29 |
| SP96 | Ac-F$r8AYWEAL$AANlel-NH2 | 105 | | 1599.91 | 801.7 | 1600.92 | 800.96 | 534.31 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
| --- | --- | --- | --- | --- | --- | --- | --- | --- |
| SP97 | Ac-F$r8AYWEAL$AAN1e1-NH2 | 106 | iso2 | 1599.91 | 801.42 | 1600.92 | 800.96 | 534.31 |
| SP98 | Ac-LTF$r8AY6clWAQL$SAA-NH2 | 107 | | 1707.88 | 855.72 | 1708.89 | 854.95 | 570.3 |
| SP99 | Ac-LTF$r8AY6clWAQL$SAA-NH2 | 108 | iso2 | 1707.88 | 855.35 | 1708.89 | 854.95 | 570.3 |
| SP100 | Ac-WTF$r8FYWSQL$AVAa-NH2 | 109 | | 1922.01 | 962.21 | 1923.02 | 962.01 | 641.68 |
| SP101 | Ac-WTF$r8FYWSQL$AVAa-NH2 | 110 | iso2 | 1922.01 | 962.49 | 1923.02 | 962.01 | 641.68 |
| SP102 | Ac-WTF$r8VYWSQL$AVA-NH2 | 111 | | 1802.98 | 902.72 | 1803.99 | 902.5 | 602 |
| SP103 | Ac-WTF$r8VYWSQL$AVA-NH2 | 112 | iso2 | 1802.98 | 903 | 1803.99 | 902.5 | 602 |
| SP104 | Ac-WTF$r8FYWSQL$SAAa-NH2 | 113 | | 1909.98 | 956.47 | 1910.99 | 956 | 637.67 |
| SP105 | Ac-WTF$r8FYWSQL$SAAa-NH2 | 114 | iso2 | 1909.98 | 956.47 | 1910.99 | 956 | 637.67 |
| SP106 | Ac-WTF$r8VYWSQL$AVAaa-NH2 | 115 | | 1945.05 | 974.15 | 1946.06 | 973.53 | 649.36 |
| SP107 | Ac-WTF$r8VYWSQL$AVAaa-NH2 | 116 | iso2 | 1945.05 | 973.78 | 1946.06 | 973.53 | 649.36 |
| SP108 | Ac-LTF$r8AYWAQL$AVG-NH2 | 117 | | 1671.94 | 837.52 | 1672.95 | 836.98 | 558.32 |
| SP109 | Ac-LTF$r8AYWAQL$AVG-NH2 | 118 | iso2 | 1671.94 | 837.21 | 1672.95 | 836.98 | 558.32 |
| SP110 | Ac-LTF$r8AYWAQL$AVQ-NH2 | 119 | | 1742.98 | 872.74 | 1743.99 | 872.5 | 582 |
| SP111 | Ac-LTF$r8AYWAQL$AVQ-NH2 | 120 | iso2 | 1742.98 | 872.74 | 1743.99 | 872.5 | 582 |
| SP112 | Ac-LTF$r8AYWAQL$SAa-NH2 | 121 | | 1673.92 | 838.23 | 1674.93 | 837.97 | 558.98 |
| SP113 | Ac-LTF$r8AYWAQL$SAa-NH2 | 122 | iso2 | 1673.92 | 838.32 | 1674.93 | 837.97 | 558.98 |
| SP114 | Ac-LTF$r8AYWAQhL$SAA-NH2 | 123 | | 1687.93 | 844.37 | 1688.94 | 844.97 | 563.65 |
| SP115 | Ac-LTF$r8AYWAQhL$SAA-NH2 | 124 | iso2 | 1687.93 | 844.81 | 1688.94 | 844.97 | 563.65 |
| SP116 | Ac-LTF$r8AYWEQLStSA$-NH2 | 125 | | 1826 | 905.27 | 1827.01 | 914.01 | 609.67 |
| SP117 | Ac-LTF$r8AYWAQL$SLA-NH2 | 126 | | 1715.97 | 858.48 | 1716.98 | 858.99 | 573 |
| SP118 | Ac-LTF$r8AYWAQL$SLA-NH2 | 127 | iso2 | 1715.97 | 858.87 | 1716.98 | 858.99 | 573 |
| SP119 | Ac-LTF$r8AYWAQL$SWA-NH2 | 128 | | 1788.96 | 895.21 | 1789.97 | 895.49 | 597.33 |
| SP120 | Ac-LTF$r8AYWAQL$SWA-NH2 | 129 | iso2 | 1788.96 | 895.28 | 1789.97 | 895.49 | 597.33 |
| SP121 | Ac-LTF$r8AYWAQL$SVS-NH2 | 130 | | 1717.94 | 859.84 | 1718.95 | 859.98 | 573.65 |
| SP122 | Ac-LTF$r8AYWAQL$SAS-NH2 | 131 | | 1689.91 | 845.85 | 1690.92 | 845.96 | 564.31 |
| SP123 | Ac-LTF$r8AYWAQL$SVG-NH2 | 132 | | 1687.93 | 844.81 | 1688.94 | 844.97 | 563.65 |
| SP124 | Ac-ETF$r8VYWAQL$SAa-NH2 | 133 | | 1717.91 | 859.76 | 1718.92 | 859.96 | 573.64 |
| SP125 | Ac-ETF$r8VYWAQL$SAA-NH2 | 134 | | 1717.91 | 859.84 | 1718.92 | 859.96 | 573.64 |
| SP126 | Ac-ETF$r8VYWAQL$SVA-NH2 | 135 | | 1745.94 | 873.82 | 1746.95 | 873.98 | 582.99 |
| SP127 | Ac-ETF$r8VYWAQL$SLA-NH2 | 136 | | 1759.96 | 880.85 | 1760.97 | 880.99 | 587.66 |
| SP128 | Ac-ETF$r8VYWAQL$SWA-NH2 | 137 | | 1832.95 | 917.34 | 1833.96 | 917.48 | 611.99 |
| SP129 | Ac-ETF$r8KYWAQL$SWA-NH2 | 138 | | 1861.98 | 931.92 | 1862.99 | 932 | 621.67 |
| SP130 | Ac-ETF$r8VYWAQL$SVS-NH2 | 139 | | 1761.93 | 881.89 | 1762.94 | 881.97 | 588.32 |
| SP131 | Ac-ETF$r8VYWAQL$SAS-NH2 | 140 | | 1733.9 | 867.83 | 1734.91 | 867.96 | 578.97 |
| SP132 | Ac-ETF$r8VYWAQL$SVG-NH2 | 141 | | 1731.92 | 866.87 | 1732.93 | 866.97 | 578.31 |
| SP133 | Ac-LTF$r8VYWAQL$SSa-NH2 | 142 | | 1717.94 | 859.47 | 1718.95 | 859.98 | 573.65 |
| SP134 | Ac-ETF$r8VYWAQL$SSa-NH2 | 143 | | 1733.9 | 867.83 | 1734.91 | 867.96 | 578.97 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP135 | Ac-LTF$r8VYWAQL$SNa-NH2 | 144 | | 1744.96 | 873.38 | 1745.97 | 873.49 | 582.66 |
| SP136 | Ac-ETF$r8VYWAQL$SNa-NH2 | 145 | | 1760.91 | 881.3 | 1761.92 | 881.46 | 587.98 |
| SP137 | Ac-LTF$r8VYWAQL$SAa-NH2 | 146 | | 1701.95 | 851.84 | 1702.96 | 851.98 | 568.32 |
| SP138 | Ac-LTF$r8VYWAQL$SVA-NH2 | 147 | | 1729.98 | 865.53 | 1730.99 | 866 | 577.67 |
| SP139 | Ac-LTF$r8VYWAQL$SVA-NH2 | 148 | iso2 | 1729.98 | 865.9 | 1730.99 | 866 | 577.67 |
| SP140 | Ac-LTF$r8VYWAQL$SWA-NH2 | 149 | | 1816.99 | 909.42 | 1818 | 909.5 | 606.67 |
| SP141 | Ac-LTF$r8VYWAQL$SVS-NH2 | 150 | | 1745.98 | 873.9 | 1746.99 | 874 | 583 |
| SP142 | Ac-LTF$r8VYWAQL$SVS-NH2 | 151 | iso2 | 1745.98 | 873.9 | 1746.99 | 874 | 583 |
| SP143 | Ac-LTF$r8VYWAQL$SAS-NH2 | 152 | | 1717.94 | 859.84 | 1718.95 | 859.98 | 573.65 |
| SP144 | Ac-LTF$r8VYWAQL$SAS-NH2 | 153 | iso2 | 1717.94 | 859.91 | 1718.95 | 859.98 | 573.65 |
| SP145 | Ac-LTF$r8VYWAQL$SVG-NH2 | 154 | | 1715.97 | 858.87 | 1716.98 | 858.99 | 573 |
| SP146 | Ac-LTF$r8VYWAQL$SVG-NH2 | 155 | iso2 | 1715.97 | 858.87 | 1716.98 | 858.99 | 573 |
| SP147 | Ac-LTF$r8EYWAQCha$SAA-NH2 | 156 | | 1771.96 | 886.85 | 1772.97 | 886.99 | 591.66 |
| SP148 | Ac-LTF$r8EYWAQCha$SAA-NH2 | 157 | iso2 | 1771.96 | 886.85 | 1772.97 | 886.99 | 591.66 |
| SP149 | Ac-LTF$r8EYWAQCpg$SAA-NH2 | 158 | | 1743.92 | 872.86 | 1744.93 | 872.97 | 582.31 |
| SP150 | Ac-LTF$r8EYWAQCpg$SAA-NH2 | 159 | iso2 | 1743.92 | 872.86 | 1744.93 | 872.97 | 582.31 |
| SP151 | Ac-LTF$r8EYWAQF$SAA-NH2 | 160 | | 1765.91 | 883.44 | 1766.92 | 883.96 | 589.64 |
| SP152 | Ac-LTF$r8EYWAQF$SAA-NH2 | 161 | iso2 | 1765.91 | 883.89 | 1766.92 | 883.96 | 589.64 |
| SP153 | Ac-LTF$r8EYWAQCba$SAA-NH2 | 162 | | 1743.92 | 872.42 | 1744.93 | 872.97 | 582.31 |
| SP154 | Ac-LTF$r8EYWAQCba$SAA-NH2 | 163 | iso2 | 1743.92 | 873.39 | 1744.93 | 872.97 | 582.31 |
| SP155 | Ac-LTF3Cl$r8EYWAQL$SAA-NH2 | 164 | | 1765.89 | 883.89 | 1766.9 | 883.95 | 589.64 |
| SP156 | Ac-LTF3Cl$r8EYWAQL$SAA-NH2 | 165 | iso2 | 1765.89 | 883.96 | 1766.9 | 883.95 | 589.64 |
| SP157 | Ac-LTF34F2$r8EYWAQL$SAA-NH2 | 166 | | 1767.91 | 884.48 | 1768.92 | 884.96 | 590.31 |
| SP158 | Ac-LTF34F2$r8EYWAQL$SAA-NH2 | 167 | iso2 | 1767.91 | 884.48 | 1768.92 | 884.96 | 590.31 |
| SP159 | Ac-LTF34F2$r8EYWAQhL$SAA-NH2 | 168 | | 1781.92 | 891.44 | 1782.93 | 891.97 | 594.98 |
| SP160 | Ac-LTF34F2$r8EYWAQhL$SAA-NH2 | 169 | iso2 | 1781.92 | 891.88 | 1782.93 | 891.97 | 594.98 |
| SP161 | Ac-ETF$r8EYWAQL$SAA-NH2 | 170 | | 1747.88 | 874.34 | 1748.89 | 874.95 | 583.63 |
| SP162 | Ac-LTF$r8AYWVQL$SAA-NH2 | 171 | | 1701.95 | 851.4 | 1702.96 | 851.98 | 568.32 |
| SP163 | Ac-LTF$r8AHWAQL$SAA-NH2 | 172 | | 1647.91 | 824.83 | 1648.92 | 824.96 | 550.31 |
| SP164 | Ac-LTF$r8AEWAQL$SAA-NH2 | 173 | | 1639.9 | 820.39 | 1640.91 | 820.96 | 547.64 |
| SP165 | Ac-LTF$r8ASWAQL$SAA-NH2 | 174 | | 1597.89 | 799.38 | 1598.9 | 799.95 | 533.64 |
| SP166 | Ac-LTF$r8AEWAQL$SAA-NH2 | 175 | iso2 | 1639.9 | 820.39 | 1640.91 | 820.96 | 547.64 |
| SP167 | Ac-LTF$r8ASWAQL$SAA-NH2 | 176 | iso2 | 1597.89 | 800.31 | 1598.9 | 799.95 | 533.64 |
| SP168 | Ac-LTF$r8AF4coohWAQL$SAA-NH2 | 177 | | 1701.91 | 851.4 | 1702.92 | 851.96 | 568.31 |
| SP169 | Ac-LTF$r8AF4coohWAQL$SAA-NH2 | 178 | iso2 | 1701.91 | 851.4 | 1702.92 | 851.96 | 568.31 |
| SP170 | Ac-LTF$r8AHWAQL$AAIa-NH2 | 179 | | 1745 | 874.13 | 1746.01 | 873.51 | 582.67 |
| SP171 | Ac-ITF$r8FYWAQL$AAIa-NH2 | 180 | | 1847.04 | 923.92 | 1848.05 | 924.53 | 616.69 |
| SP172 | Ac-ITF$r8EHWAQL$AAIa-NH2 | 181 | | 1803.01 | 903.17 | 1804.02 | 902.51 | 602.01 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP173 | Ac-ITF$r8EHWAQL$AAIa-NH2 | 182 | iso2 | 1803.01 | 903.17 | 1804.02 | 902.51 | 602.01 |
| SP174 | Ac-ETF$r8EHWAQL$AAIa-NH2 | 183 | | 1818.97 | 910.76 | 1819.98 | 910.49 | 607.33 |
| SP175 | Ac-ETF$r8EHWAQL$AAIa-NH2 | 184 | iso2 | 1818.97 | 910.85 | 1819.98 | 910.49 | 607.33 |
| SP176 | Ac-LTF$r8AHWVQL$AAIa-NH2 | 185 | | 1773.03 | 888.09 | 1774.04 | 887.52 | 592.02 |
| SP177 | Ac-ITF$r8FYWVQL$AAIa-NH2 | 186 | | 1875.07 | 939.16 | 1876.08 | 938.54 | 626.03 |
| SP178 | Ac-ITF$r8EYWVQL$AAIa-NH2 | 187 | | 1857.04 | 929.83 | 1858.05 | 929.53 | 620.02 |
| SP179 | Ac-ITF$r8EHWVQL$AAIa-NH2 | 188 | | 1831.04 | 916.86 | 1832.05 | 916.53 | 611.35 |
| SP180 | Ac-LTF$r8AEWAQL$AAIa-NH2 | 189 | | 1736.99 | 869.87 | 1738 | 869.5 | 580 |
| SP181 | Ac-LTF$r8AF4coohWAQL$AAIa-NH2 | 190 | | 1799 | 900.17 | 1800.01 | 900.51 | 600.67 |
| SP182 | Ac-LTF$r8AF4coohWAQL$AAIa-NH2 | 191 | iso2 | 1799 | 900.24 | 1800.01 | 900.51 | 600.67 |
| SP183 | Ac-LTF$r8AHWAQL$AHFA-NH2 | 192 | | 1845.01 | 923.89 | 1846.02 | 923.51 | 616.01 |
| SP184 | Ac-ITF$r8FYWAQL$AHFA-NH2 | 193 | | 1947.05 | 975.05 | 1948.06 | 974.53 | 650.02 |
| SP185 | Ac-ITF$r8FYWAQL$AHFA-NH2 | 194 | iso2 | 1947.05 | 976.07 | 1948.06 | 974.53 | 650.02 |
| SP186 | Ac-ITF$r8FHWAQL$AEFA-NH2 | 195 | | 1913.02 | 958.12 | 1914.03 | 957.52 | 638.68 |
| SP187 | Ac-ITF$r8FHWAQL$AEFA-NH2 | 196 | iso2 | 1913.02 | 957.86 | 1914.03 | 957.52 | 638.68 |
| SP188 | Ac-ITF$r8EHWAQL$AHFA-NH2 | 197 | | 1903.01 | 952.94 | 1904.02 | 952.51 | 635.34 |
| SP189 | Ac-ITF$r8EHWAQL$AHFA-NH2 | 198 | iso2 | 1903.01 | 953.87 | 1904.02 | 952.51 | 635.34 |
| SP190 | Ac-LTF$r8AHWVQL$AHFA-NH2 | 199 | | 1873.04 | 937.86 | 1874.05 | 937.53 | 625.35 |
| SP191 | Ac-ITF$r8FYWVQL$AHFA-NH2 | 200 | | 1975.08 | 988.83 | 1976.09 | 988.55 | 659.37 |
| SP192 | Ac-ITF$r8EYWVQL$AHFA-NH2 | 201 | | 1957.05 | 979.35 | 1958.06 | 979.53 | 653.36 |
| SP193 | Ac-ITF$r8EHWVQL$AHFA-NH2 | 202 | | 1931.05 | 967 | 1932.06 | 966.53 | 644.69 |
| SP194 | Ac-ITF$r8EHWVQL$AHFA-NH2 | 203 | iso2 | 1931.05 | 967.93 | 1932.06 | 966.53 | 644.69 |
| SP195 | Ac-ETF$r8EYWAAL$SAA-NH2 | 204 | | 1690.86 | 845.85 | 1691.87 | 846.44 | 564.63 |
| SP196 | Ac-LTF$r8AYWVAL$SAA-NH2 | 205 | | 1644.93 | 824.08 | 1645.94 | 823.47 | 549.32 |
| SP197 | Ac-LTF$r8AHWAAL$SAA-NH2 | 206 | | 1590.89 | 796.88 | 1591.9 | 796.45 | 531.3 |
| SP198 | Ac-LTF$r8AEWAAL$SAA-NH2 | 207 | | 1582.88 | 791.9 | 1583.89 | 792.45 | 528.63 |
| SP199 | Ac-LTF$r8AEWAAL$SAA-NH2 | 208 | iso2 | 1582.88 | 791.9 | 1583.89 | 792.45 | 528.63 |
| SP200 | Ac-LTF$r8ASWAAL$SAA-NH2 | 209 | | 1540.87 | 770.74 | 1541.88 | 771.44 | 514.63 |
| SP201 | Ac-LTF$r8ASWAAL$SAA-NH2 | 210 | iso2 | 1540.87 | 770.88 | 1541.88 | 771.44 | 514.63 |
| SP202 | Ac-LTF$r8AYWAAL$AAIa-NH2 | 211 | | 1713.99 | 857.39 | 1715 | 858 | 572.34 |
| SP203 | Ac-LTF$r8AYWAAL$AAIa-NH2 | 212 | iso2 | 1713.99 | 857.84 | 1715 | 858 | 572.34 |
| SP204 | Ac-LTF$r8AYWAAL$AHFA-NH2 | 213 | | 1813.99 | 907.86 | 1815 | 908 | 605.67 |
| SP205 | Ac-LTF$r8EHWAQL$AHIa-NH2 | 214 | | 1869.03 | 936.1 | 1870.04 | 935.52 | 624.02 |
| SP206 | Ac-LTF$r8EHWAQL$AHIa-NH2 | 215 | iso2 | 1869.03 | 937.03 | 1870.04 | 935.52 | 624.02 |
| SP207 | Ac-LTF$r8AHWAQL$AHIa-NH2 | 216 | | 1811.03 | 906.87 | 1812.04 | 906.52 | 604.68 |
| SP208 | Ac-LTF$r8EYWAQL$AHIa-NH2 | 217 | | 1895.04 | 949.15 | 1896.05 | 948.53 | 632.69 |
| SP209 | Ac-LTF$r8AYWAQL$AAFa-NH2 | 218 | | 1804.99 | 903.2 | 1806 | 903.5 | 602.67 |
| SP210 | Ac-LTF$r8AYWAQL$AAFa-NH2 | 219 | iso2 | 1804.99 | 903.28 | 1806 | 903.5 | 602.67 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP211 | Ac-LTF$r8AYWAQL$AAWa-NH2 | 220 | | 1844 | 922.81 | 1845.01 | 923.01 | 615.67 |
| SP212 | Ac-LTF$r8AYWAQL$AAVa-NH2 | 221 | | 1756.99 | 878.86 | 1758 | 879.5 | 586.67 |
| SP213 | Ac-LTF$r8AYWAQL$AAVa-NH2 | 222 | iso2 | 1756.99 | 879.3 | 1758 | 879.5 | 586.67 |
| SP214 | Ac-LTF$r8AYWAQL$AALa-NH2 | 223 | | 1771.01 | 886.26 | 1772.02 | 886.51 | 591.34 |
| SP215 | Ac-LTF$r8AYWAQL$AALa-NH2 | 224 | iso2 | 1771.01 | 886.33 | 1772.02 | 886.51 | 591.34 |
| SP216 | Ac-LTF$r8EYWAQL$AAIa-NH2 | 225 | | 1829.01 | 914.89 | 1830.02 | 915.51 | 610.68 |
| SP217 | Ac-LTF$r8EYWAQL$AAIa-NH2 | 226 | iso2 | 1829.01 | 915.34 | 1830.02 | 915.51 | 610.68 |
| SP218 | Ac-LTF$r8EYWAQL$AAFa-NH2 | 227 | | 1863 | 932.87 | 1864.01 | 932.51 | 622.01 |
| SP219 | Ac-LTF$r8EYWAQL$AAFa-NH2 | 228 | iso2 | 1863 | 932.87 | 1864.01 | 932.51 | 622.01 |
| SP220 | Ac-LTF$r8EYWAQL$AAVa-NH2 | 229 | | 1815 | 908.23 | 1816.01 | 908.51 | 606.01 |
| SP221 | Ac-LTF$r8EYWAQL$AAVa-NH2 | 230 | iso2 | 1815 | 908.31 | 1816.01 | 908.51 | 606.01 |
| SP222 | Ac-LTF$r8EHWAQL$AAIa-NH2 | 231 | | 1803.01 | 903.17 | 1804.02 | 902.51 | 602.01 |
| SP223 | Ac-LTF$r8EHWAQL$AAIa-NH2 | 232 | iso2 | 1803.01 | 902.8 | 1804.02 | 902.51 | 602.01 |
| SP224 | Ac-LTF$r8EHWAQL$AAWa-NH2 | 233 | | 1876 | 939.34 | 1877.01 | 939.01 | 626.34 |
| SP225 | Ac-LTF$r8EHWAQL$AAWa-NH2 | 234 | iso2 | 1876 | 939.62 | 1877.01 | 939.01 | 626.34 |
| SP226 | Ac-LTF$r8EHWAQL$AALa-NH2 | 235 | | 1803.01 | 902.8 | 1804.02 | 902.51 | 602.01 |
| SP227 | Ac-LTF$r8EHWAQL$AALa-NH2 | 236 | iso2 | 1803.01 | 902.9 | 1804.02 | 902.51 | 602.01 |
| SP228 | Ac-ETF$r8EHWVQL$AALa-NH2 | 237 | | 1847 | 924.82 | 1848.01 | 924.51 | 616.67 |
| SP229 | Ac-LTF$r8AYWAQL$AAAa-NH2 | 238 | | 1728.96 | 865.89 | 1729.97 | 865.49 | 577.33 |
| SP230 | Ac-LTF$r8AYWAQL$AAAa-NH2 | 239 | iso2 | 1728.96 | 865.89 | 1729.97 | 865.49 | 577.33 |
| SP231 | Ac-LTF$r8AYWAQL$AAAibA-NH2 | 240 | | 1742.98 | 872.83 | 1743.99 | 872.5 | 582 |
| SP232 | Ac-LTF$r8AYWAQL$AAAibA-NH2 | 241 | iso2 | 1742.98 | 872.92 | 1743.99 | 872.5 | 582 |
| SP233 | Ac-LTF$r8AYWAQL$AAAAa-NH2 | 242 | | 1800 | 901.42 | 1801.01 | 901.01 | 601.01 |
| SP234 | Ac-LTF$r5AYWAQL$s8AAIa-NH2 | 243 | | 1771.01 | 887.17 | 1772.02 | 886.51 | 591.34 |
| SP235 | Ac-LTF$r5AYWAQL$s8SAA-NH2 | 244 | | 1673.92 | 838.33 | 1674.93 | 837.97 | 558.98 |
| SP236 | Ac-LTF$r8AYWAQCba$AANleA-NH2 | 245 | | 1783.01 | 892.64 | 1784.02 | 892.51 | 595.34 |
| SP237 | Ac-ETF$r8AYWAQCba$AANleA-NH2 | 246 | | 1798.97 | 900.59 | 1799.98 | 900.49 | 600.66 |
| SP238 | Ac-LTF$r8EYWAQCba$AANleA-NH2 | 247 | | 1841.01 | 922.05 | 1842.02 | 921.51 | 614.68 |
| SP239 | Ac-LTF$r8AYWAQCba$AWNleA-NH2 | 248 | | 1898.05 | 950.46 | 1899.06 | 950.03 | 633.69 |
| SP240 | Ac-ETF$r8AYWAQCba$AWNleA-NH2 | 249 | | 1914.01 | 958.11 | 1915.02 | 958.01 | 639.01 |
| SP241 | Ac-LTF$r8EYWAQCba$AWNleA-NH2 | 250 | | 1956.06 | 950.62 | 1957.07 | 979.04 | 653.03 |
| SP242 | Ac-LTF$r8EYWAQCba$SAFA-NH2 | 251 | | 1890.99 | 946.55 | 1892 | 946.5 | 631.34 |
| SP243 | Ac-LTF34F2$r8EYWAQCba$SANleA-NH2 | 252 | | 1892.99 | 947.57 | 1894 | 947.5 | 632 |
| SP244 | Ac-LTF$r8EF4coohWAQCba$SANleA-NH2 | 253 | | 1885 | 943.59 | 1886.01 | 943.51 | 629.34 |
| SP245 | Ac-LTF$r8EYWSQCba$SANleA-NH2 | 254 | | 1873 | 937.58 | 1874.01 | 937.51 | 625.34 |
| SP246 | Ac-LTF$r8EYWWQCba$SANleA-NH2 | 255 | | 1972.05 | 987.61 | 1973.06 | 987.03 | 658.36 |
| SP247 | Ac-LTF$r8EYWAQCba$AAIa-NH2 | 256 | | 1841.01 | 922.05 | 1842.02 | 921.51 | 614.68 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
| --- | --- | --- | --- | --- | --- | --- | --- | --- |
| SP248 | Ac-LTF34F2$r8EYWAQCba$AAIa-NH2 | 257 | | 1876.99 | 939.99 | 1878 | 939.5 | 626.67 |
| SP249 | Ac-LTF$r8EF4coohWAQCba$AAIa-NH2 | 258 | | 1869.01 | 935.64 | 1870.02 | 935.51 | 624.01 |
| SP250 | Pam-ETF$r8EYWAQCba$SAA-NH2 | 259 | | 1956.1 | 979.57 | 1957.11 | 979.06 | 653.04 |
| SP251 | Ac-LThF$r8EFWAQCba$SAA-NH2 | 260 | | 1741.94 | 872.11 | 1742.95 | 871.98 | 581.65 |
| SP252 | Ac-LTA$r8EYWAQCba$SAA-NH2 | 261 | | 1667.89 | 835.4 | 1668.9 | 834.95 | 556.97 |
| SP253 | Ac-LTF$r8EYAAQCba$SAA-NH2 | 262 | | 1628.88 | 815.61 | 1629.89 | 815.45 | 543.97 |
| SP254 | Ac-LTF$r8EY2NalAQCba$SAA-NH2 | 263 | | 1754.93 | 879.04 | 1755.94 | 878.47 | 585.98 |
| SP255 | Ac-LTF$r8AYWAQCba$SAA-NH2 | 264 | | 1685.92 | 844.71 | 1686.93 | 843.97 | 562.98 |
| SP256 | Ac-LTF$r8EYWAQCba$SAF-NH2 | 265 | | 1819.96 | 911.41 | 1820.97 | 910.99 | 607.66 |
| SP257 | Ac-LTF$r8EYWAQCba$SAFa-NH2 | 266 | | 1890.99 | 947.41 | 1892 | 946.5 | 631.34 |
| SP258 | Ac-LTF$r8AYWAQCba$SAF-NH2 | 267 | | 1761.95 | 882.73 | 1762.96 | 881.98 | 588.32 |
| SP259 | Ac-LTF34F2$r8AYWAQCba$SAF-NH2 | 268 | | 1797.93 | 900.87 | 1798.94 | 899.97 | 600.32 |
| SP260 | Ac-LTF$r8AF4coohWAQCba$SAF-NH2 | 269 | | 1789.94 | 896.43 | 1790.95 | 895.98 | 597.65 |
| SP261 | Ac-LTF$r8EY6c1WAQCba$SAF-NH2 | 270 | | 1853.92 | 929.27 | 1854.93 | 927.97 | 618.98 |
| SP262 | Ac-LTF$r8AYWSQCba$SAF-NH2 | 271 | | 1777.94 | 890.87 | 1778.95 | 889.98 | 593.65 |
| SP263 | Ac-LTF$r8AYWWQCba$SAF-NH2 | 272 | | 1876.99 | 939.91 | 1878 | 939.5 | 626.67 |
| SP264 | Ac-LTF$r8AYWAQCba$AAIa-NH2 | 273 | | 1783.01 | 893.19 | 1784.02 | 892.51 | 595.34 |
| SP265 | Ac-LTF34F2$r8AYWAQCba$AAIa-NH2 | 274 | | 1818.99 | 911.23 | 1820 | 910.5 | 607.34 |
| SP266 | Ac-LTF$r8AY6c1WAQCba$AAIa-NH2 | 275 | | 1816.97 | 909.84 | 1817.98 | 909.49 | 606.66 |
| SP267 | Ac-LTF$r8AF4coohWAQCba$AAIa-NH2 | 276 | | 1811 | 906.88 | 1812.01 | 906.51 | 604.67 |
| SP268 | Ac-LTF$r8EYWAQCba$AAFa-NH2 | 277 | | 1875 | 938.6 | 1876.01 | 938.51 | 626.01 |
| SP269 | Ac-LTF$r8EYWAQCba$AAFa-NH2 | 278 | iso2 | 1875 | 938.6 | 1876.01 | 938.51 | 626.01 |
| SP270 | Ac-ETF$r8AYWAQCba$AWNlea-NH2 | 279 | | 1914.01 | 958.42 | 1915.02 | 958.01 | 639.01 |
| SP271 | Ac-LTF$r8EYWAQCba$AWNlea-NH2 | 280 | | 1956.06 | 979.42 | 1957.07 | 979.04 | 653.03 |
| SP272 | Ac-ETF$r8EYWAQCba$AWNlea-NH2 | 281 | | 1972.01 | 987.06 | 1973.02 | 987.01 | 658.34 |
| SP273 | Ac-ETF$r8EYWAQCba$AWNlea-NH2 | 282 | iso2 | 1972.01 | 987.06 | 1973.02 | 987.01 | 658.34 |
| SP274 | Ac-LTF$r8AYWAQCba$SAFa-NH2 | 283 | | 1832.99 | 917.89 | 1834 | 917.5 | 612 |
| SP275 | Ac-LTF$r8AYWAQCba$SAFa-NH2 | 284 | iso2 | 1832.99 | 918.07 | 1834 | 917.5 | 612 |
| SP276 | Ac-ETF$r8AYWAQL$AWNlea-NH2 | 285 | | 1902.01 | 952.22 | 1903.02 | 952.01 | 635.01 |
| SP277 | Ac-LTF$r8EYWAQL$AWNlea-NH2 | 286 | | 1944.06 | 973.5 | 1945.07 | 973.04 | 649.03 |
| SP278 | Ac-ETF$r8EYWAQL$AWNlea-NH2 | 287 | | 1960.01 | 981.46 | 1961.02 | 981.01 | 654.34 |
| SP279 | Dmaac-LTF$r8EYWAQhL$SAA-NH2 | 288 | | 1788.98 | 896.06 | 1789.99 | 895.5 | 597.33 |
| SP280 | Hexac-LTF$r8EYWAQhL$SAA-NH2 | 289 | | 1802 | 902.9 | 1803.01 | 902.01 | 601.67 |
| SP281 | Napac-LTF$r8EYWAQhL$SAA-NH2 | 290 | | 1871.99 | 937.58 | 1873 | 937 | 625 |
| SP282 | Decac-LTF$r8EYWAQhL$SAA-NH2 | 291 | | 1858.06 | 930.55 | 1859.07 | 930.04 | 620.36 |
| SP283 | Admac-LTF$r8EYWAQhL$SAA-NH2 | 292 | | 1866.03 | 934.07 | 1867.04 | 934.02 | 623.02 |
| SP284 | Tmac-LTF$r8EYWAQhL$SAA-NH2 | 293 | | 1787.99 | 895.41 | 1789 | 895 | 597 |
| SP285 | Pam-LTF$r8EYWAQhL$SAA-NH2 | 294 | | 1942.16 | 972.08 | 1943.17 | 972.09 | 648.39 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP286 | Ac-LTF$r8AYWAQCba$AANleA-NH2 | 295 | iso2 | 1783.01 | 892.64 | 1784.02 | 892.51 | 595.34 |
| SP287 | Ac-LTF34F2$r8EYWAQCba$AAIa-NH2 | 296 | iso2 | 1876.99 | 939.62 | 1878 | 939.5 | 626.67 |
| SP288 | Ac-LTF34F2$r8EYWAQCba$SAA-NH2 | 297 | | 1779.91 | 892.07 | 1780.92 | 890.96 | 594.31 |
| SP289 | Ac-LTF34F2$r8EYWAQCba$SAA-NH2 | 298 | iso2 | 1779.91 | 891.61 | 1780.92 | 890.96 | 594.31 |
| SP290 | Ac-LTF$r8EF4coohWAQCba$SAA-NH2 | 299 | | 1771.92 | 887.54 | 1772.93 | 886.97 | 591.65 |
| SP291 | Ac-LTF$r8EF4coohWAQCba$SAA-NH2 | 300 | iso2 | 1771.92 | 887.63 | 1772.93 | 886.97 | 591.65 |
| SP292 | Ac-LTF$r8EYWSQCba$SAA-NH2 | 301 | | 1759.92 | 881.9 | 1760.93 | 880.97 | 587.65 |
| SP293 | Ac-LTF$r8EYWSQCba$SAA-NH2 | 302 | iso2 | 1759.92 | 881.9 | 1760.93 | 880.97 | 587.65 |
| SP294 | Ac-LTF$r8EYWAQhL$SAA-NH2 | 303 | | 1745.94 | 875.05 | 1746.95 | 873.98 | 582.99 |
| SP295 | Ac-LTF$r8AYWAQhL$SAF-NH2 | 304 | | 1763.97 | 884.02 | 1764.98 | 882.99 | 589 |
| SP296 | Ac-LTF$r8AYWAQhL$SAF-NH2 | 305 | iso2 | 1763.97 | 883.56 | 1764.98 | 882.99 | 589 |
| SP297 | Ac-LTF34F2$r8AYWAQhL$SAA-NH2 | 306 | | 1723.92 | 863.67 | 1724.93 | 862.97 | 575.65 |
| SP298 | Ac-LTF34F2$r8AYWAQhL$SAA-NH2 | 307 | iso2 | 1723.92 | 864.04 | 1724.93 | 862.97 | 575.65 |
| SP299 | Ac-LTF$r8AF4coohWAQhL$SAA-NH2 | 308 | | 1715.93 | 859.44 | 1716.94 | 858.97 | 572.98 |
| SP300 | Ac-LTF$r8AF4coohWAQhL$SAA-NH2 | 309 | iso2 | 1715.93 | 859.6 | 1716.94 | 858.97 | 572.98 |
| SP301 | Ac-LTF$r8AYWSQhL$SAA-NH2 | 310 | | 1703.93 | 853.96 | 1704.94 | 852.97 | 568.98 |
| SP302 | Ac-LTF$r8AYWSQhL$SAA-NH2 | 311 | iso2 | 1703.93 | 853.59 | 1704.94 | 852.97 | 568.98 |
| SP303 | Ac-LTF$r8EYWAQL$AANleA-NH2 | 312 | | 1829.01 | 915.45 | 1830.02 | 915.51 | 610.68 |
| SP304 | Ac-LTF34F2$r8AYWAQL$AANleA-NH2 | 313 | | 1806.99 | 904.58 | 1808 | 904.5 | 603.34 |
| SP305 | Ac-LTF$r8AF4coohWAQL$AANleA-NH2 | 314 | | 1799 | 901.6 | 1800.01 | 900.51 | 600.67 |
| SP306 | Ac-LTF$r8AYWSQL$AANleA-NH2 | 315 | | 1787 | 894.75 | 1788.01 | 894.51 | 596.67 |
| SP307 | Ac-LTF34F2$r8AYWAQhL$AANleA-NH2 | 316 | | 1821 | 911.79 | 1822.01 | 911.51 | 608.01 |
| SP308 | Ac-LTF34F2$r8AYWAQhL$AANleA-NH2 | 317 | iso2 | 1821 | 912.61 | 1822.01 | 911.51 | 608.01 |
| SP309 | Ac-LTF$r8AF4coohWAQhL$AANleA-NH2 | 318 | | 1813.02 | 907.95 | 1814.03 | 907.52 | 605.35 |
| SP310 | Ac-LTF$r8AF4coohWAQhL$AANleA-NH2 | 319 | iso2 | 1813.02 | 908.54 | 1814.03 | 907.52 | 605.35 |
| SP311 | Ac-LTF$r8AYWSQhL$AANleA-NH2 | 320 | | 1801.02 | 901.84 | 1802.03 | 901.52 | 601.35 |
| SP312 | Ac-LTF$r8AYWSQhL$AANleA-NH2 | 321 | iso2 | 1801.02 | 902.62 | 1802.03 | 901.52 | 601.35 |
| SP313 | Ac-LTF$r8AYWAQhL$AAAAa-NH2 | 322 | | 1814.01 | 908.63 | 1815.02 | 908.01 | 605.68 |
| SP314 | Ac-LTF$r8AYWAQhL$AAAAa-NH2 | 323 | iso2 | 1814.01 | 908.34 | 1815.02 | 908.01 | 605.68 |
| SP315 | Ac-LTF$r8AYWAQL$AAAAAa-NH2 | 324 | | 1871.04 | 936.94 | 1872.05 | 936.53 | 624.69 |
| SP316 | Ac-LTF$r8AYWAQL$AAAAAa-NH2 | 325 | iso2 | 1942.07 | 972.5 | 1943.08 | 972.04 | 648.37 |
| SP317 | Ac-LTF$r8AYWAQL$AAAAAa-NH2 | 326 | iso1 | 1942.07 | 972.5 | 1943.08 | 972.04 | 648.37 |
| SP318 | Ac-LTF$r8EYWAQhL$AANleA-NH2 | 327 | | 1843.03 | 922.54 | 1844.04 | 922.52 | 615.35 |
| SP319 | Ac-AATF$r8AYWAQL$AANleA-NH2 | 328 | | 1800 | 901.39 | 1801.01 | 901.01 | 601.01 |
| SP320 | Ac-LTF$r8AYWAQL$AANleAA-NH2 | 329 | | 1842.04 | 922.45 | 1843.05 | 922.03 | 615.02 |
| SP321 | Ac-ALTF$r8AYWAQL$AANleAA-NH2 | 330 | | 1913.08 | 957.94 | 1914.09 | 957.55 | 638.7 |
| SP322 | Ac-LTF$r8AYWAQCba$AANleAA-NH2 | 331 | | 1854.04 | 928.43 | 1855.05 | 928.03 | 619.02 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP323 | Ac-LTF$r8AYWAQhL$AAN1eAA-NH2 | 332 | | 1856.06 | 929.4 | 1857.07 | 929.04 | 619.69 |
| SP324 | Ac-LTF$r8EYWAQCba$SAAA-NH2 | 333 | | 1814.96 | 909.37 | 1815.97 | 908.49 | 605.99 |
| SP325 | Ac-LTF$r8EYWAQCba$SAAA-NH2 | 334 | iso2 | 1814.96 | 909.37 | 1815.97 | 908.49 | 605.99 |
| SP326 | Ac-LTF$r8EYWAQCba$SAAAA-NH2 | 335 | | 1886 | 944.61 | 1887.01 | 944.01 | 629.67 |
| SP327 | Ac-LTF$r8EYWAQCba$SAAAA-NH2 | 336 | iso2 | 1886 | 944.61 | 1887.01 | 944.01 | 629.67 |
| SP328 | Ac-ALTF$r8EYWAQCba$SAA-NH2 | 337 | | 1814.96 | 909.09 | 1815.97 | 908.49 | 605.99 |
| SP329 | Ac-ALTF$r8EYWAQCba$SAAA-NH2 | 338 | | 1886 | 944.61 | 1887.01 | 944.01 | 629.67 |
| SP330 | Ac-ALTF$r8EYWAQCba$SAA-NH2 | 339 | iso2 | 1814.96 | 909.09 | 1815.97 | 908.49 | 605.99 |
| SP331 | Ac-LTF$r8EYWAQL$AAAAAa-NH2 | 340 | iso2 | 1929.04 | 966.08 | 1930.05 | 965.53 | 644.02 |
| SP332 | Ac-LTF$r8EY6clWAQCba$SAA-NH2 | 341 | | 1777.89 | 890.78 | 1778.9 | 889.95 | 593.64 |
| SP333 | Ac-LTF$r8EF4cooh6clWAQCba$SAN1eA-NH2 | 342 | | 1918.96 | 961.27 | 1919.97 | 960.49 | 640.66 |
| SP334 | Ac-LTF$r8EF4cooh6clWAQCba$SAN1eA-NH2 | 343 | iso2 | 1918.96 | 961.27 | 1919.97 | 960.49 | 640.66 |
| SP335 | Ac-LTF$r8EF4cooh6clWAQCba$AAIa-NH2 | 344 | | 1902.97 | 953.03 | 1903.98 | 952.49 | 635.33 |
| SP336 | Ac-LTF$r8EF4cooh6clWAQCba$AAIa-NH2 | 345 | iso2 | 1902.97 | 953.13 | 1903.98 | 952.49 | 635.33 |
| SP337 | Ac-LTF$r8AY6clWAQL$AAAAAa-NH2 | 346 | | 1905 | 954.61 | 1906.01 | 953.51 | 636.01 |
| SP338 | Ac-LTF$r8AY6clWAQL$AAAAAa-NH2 | 347 | iso2 | 1905 | 954.9 | 1906.01 | 953.51 | 636.01 |
| SP339 | Ac-F$r8AY6clWEAL$AAAAAAa-NH2 | 348 | | 1762.89 | 883.01 | 1763.9 | 882.45 | 588.64 |
| SP340 | Ac-ETF$r8EYWAQL$AAAAAa-NH2 | 349 | | 1945 | 974.31 | 1946.01 | 973.51 | 649.34 |
| SP341 | Ac-ETF$r8EYWAQL$AAAAAa-NH2 | 350 | iso2 | 1945 | 974.49 | 1946.01 | 973.51 | 649.34 |
| SP342 | Ac-LTF$r8EYWAQL$AAAAAAa-NH2 | 351 | | 2000.08 | 1001.6 | 2001.09 | 1001.05 | 667.7 |
| SP343 | Ac-LTF$r8EYWAQL$AAAAAAa-NH2 | 352 | iso2 | 2000.08 | 1001.6 | 2001.09 | 1001.05 | 667.7 |
| SP344 | Ac-LTF$r8AYWAQL$AAN1eAAa-NH2 | 353 | | 1913.08 | 958.58 | 1914.09 | 957.55 | 638.7 |
| SP345 | Ac-LTF$r8AYWAQL$AAN1eAAa-NH2 | 354 | iso2 | 1913.08 | 958.58 | 1914.09 | 957.55 | 638.7 |
| SP346 | Ac-LTF$r8EYWAQCba$AAAAAa-NH2 | 355 | | 1941.04 | 972.55 | 1942.05 | 971.53 | 648.02 |
| SP347 | Ac-LTF$r8EYWAQCba$AAAAAa-NH2 | 356 | iso2 | 1941.04 | 972.55 | 1942.05 | 971.53 | 648.02 |
| SP348 | Ac-LTF$r8EF4coohWAQCba$AAAAAa-NH2 | 357 | | 1969.04 | 986.33 | 1970.05 | 985.53 | 657.35 |
| SP349 | Ac-LTF$r8EF4coohWAQCba$AAAAAa-NH2 | 358 | iso2 | 1969.04 | 986.06 | 1970.05 | 985.53 | 657.35 |
| SP350 | Ac-LTF$r8EYWSQCba$AAAAAa-NH2 | 359 | | 1957.04 | 980.04 | 1958.05 | 979.53 | 653.35 |
| SP351 | Ac-LTF$r8EYWSQCba$AAAAAa-NH2 | 360 | iso2 | 1957.04 | 980.04 | 1958.05 | 979.53 | 653.35 |
| SP352 | Ac-LTF$r8EYWAQCba$SAAa-NH2 | 361 | | 1814.96 | 909 | 1815.97 | 908.49 | 605.99 |
| SP353 | Ac-LTF$r8EYWAQCba$SAAa-NH2 | 362 | iso2 | 1814.96 | 909 | 1815.97 | 908.49 | 605.99 |
| SP354 | Ac-ALTF$r8EYWAQCba$SAAa-NH2 | 363 | | 1886 | 944.52 | 1887.01 | 944.01 | 629.67 |
| SP355 | Ac-ALTF$r8EYWAQCba$SAAa-NH2 | 364 | iso2 | 1886 | 944.98 | 1887.01 | 944.01 | 629.67 |
| SP356 | Ac-ALTF$r8EYWAQCba$SAAAa-NH2 | 365 | | 1957.04 | 980.04 | 1958.05 | 979.53 | 653.35 |
| SP357 | Ac-ALTF$r8EYWAQCba$SAAAa-NH2 | 366 | iso2 | 1957.04 | 980.04 | 1958.05 | 979.53 | 653.35 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP358 | Ac-AALTF$r8EYWAQCba$SAAAa-NH2 | 367 | | 2028.07 | 1016.1 | 2029.08 | 1015.04 | 677.03 |
| SP359 | Ac-AALTF$r8EYWAQCba$SAAAa-NH2 | 368 | iso2 | 2028.07 | 1015.57 | 2029.08 | 1015.04 | 677.03 |
| SP360 | Ac-RTF$r8EYWAQCba$SAA-NH2 | 369 | | 1786.94 | 895.03 | 1787.95 | 894.48 | 596.65 |
| SP361 | Ac-LRF$r8EYWAQCba$SAA-NH2 | 370 | | 1798.98 | 901.51 | 1799.99 | 900.5 | 600.67 |
| SP362 | Ac-LTF$r8EYWRQCba$SAA-NH2 | 371 | | 1828.99 | 916.4 | 1830 | 915.5 | 610.67 |
| SP363 | Ac-LTF$r8EYWARCba$SAA-NH2 | 372 | | 1771.97 | 887.63 | 1772.98 | 886.99 | 591.66 |
| SP364 | Ac-LTF$r8EYWAQCba$RAA-NH2 | 373 | | 1812.99 | 908.08 | 1814 | 907.5 | 605.34 |
| SP365 | Ac-LTF$r8EYWAQCba$SRA-NH2 | 374 | | 1828.99 | 916.12 | 1830 | 915.5 | 610.67 |
| SP366 | Ac-LTF$r8EYWAQCba$SAR-NH2 | 375 | | 1828.99 | 916.12 | 1830 | 915.5 | 610.67 |
| SP367 | 5-FAM-BaLTF$r8EYWAQCba$SAA-NH2 | 376 | | 2131 | 1067.09 | 2132.01 | 1066.51 | 711.34 |
| SP368 | 5-FAM-BaLTF$r8AYWAQL$AANleA-NH2 | 377 | | 2158.08 | 1080.6 | 2159.09 | 1080.05 | 720.37 |
| SP369 | Ac-LAF$r8EYWAQL$AANleA-NH2 | 378 | | 1799 | 901.05 | 1800.01 | 900.51 | 600.67 |
| SP370 | Ac-ATF$r8EYWAQL$AANleA-NH2 | 379 | | 1786.97 | 895.03 | 1787.98 | 894.49 | 596.66 |
| SP371 | Ac-AAF$r8EYWAQL$AANleA-NH2 | 380 | | 1756.96 | 880.05 | 1757.97 | 879.49 | 586.66 |
| SP372 | Ac-AAAF$r8EYWAQL$AANleA-NH2 | 381 | | 1827.99 | 915.57 | 1829 | 915 | 610.34 |
| SP373 | Ac-AAAAF$r8EYWAQL$AANleA-NH2 | 382 | | 1899.03 | 951.09 | 1900.04 | 950.52 | 634.02 |
| SP374 | Ac-AATF$r8EYWAQL$AANleA-NH2 | 383 | | 1858 | 930.92 | 1859.01 | 930.01 | 620.34 |
| SP375 | Ac-AALTF$r8EYWAQL$AANleA-NH2 | 384 | | 1971.09 | 987.17 | 1972.1 | 986.55 | 658.04 |
| SP376 | Ac-AAALTF$r8EYWAQL$AANleA-NH2 | 385 | | 2042.12 | 1023.15 | 2043.13 | 1022.07 | 681.71 |
| SP377 | Ac-LTF$r8EYWAQL$AANleAA-NH2 | 386 | | 1900.05 | 952.02 | 1901.06 | 951.03 | 634.36 |
| SP378 | Ac-ALTF$r8EYWAQL$AANleAA-NH2 | 387 | | 1971.09 | 987.63 | 1972.1 | 986.55 | 658.04 |
| SP379 | Ac-AALTF$r8EYWAQL$AANleAA-NH2 | 388 | | 2042.12 | 1022.69 | 2043.13 | 1022.07 | 681.71 |
| SP380 | Ac-LTF$r8EYWAQCba$AANleAA-NH2 | 389 | | 1912.05 | 958.03 | 1913.06 | 957.03 | 638.36 |
| SP381 | Ac-LTF$r8EYWAQhL$AANleAA-NH2 | 390 | | 1914.07 | 958.68 | 1915.08 | 958.04 | 639.03 |
| SP382 | Ac-ALTF$r8EYWAQhL$AANleAA-NH2 | 391 | | 1985.1 | 994.1 | 1986.11 | 993.56 | 662.71 |
| SP383 | Ac-LTF$r8ANmYWAQL$AANleA-NH2 | 392 | | 1785.02 | 894.11 | 1786.03 | 893.52 | 596.01 |
| SP384 | Ac-LTF$r8ANmYWAQL$AANleA-NH2 | 393 | iso2 | 1785.02 | 894.11 | 1786.03 | 893.52 | 596.01 |
| SP385 | Ac-LTF$r8AYNmWAQL$AANleA-NH2 | 394 | | 1785.02 | 894.11 | 1786.03 | 893.52 | 596.01 |
| SP386 | Ac-LTF$r8AYNmWAQL$AANleA-NH2 | 395 | iso2 | 1785.02 | 894.11 | 1786.03 | 893.52 | 596.01 |
| SP387 | Ac-LTF$r8AYAmWAQL$AANleA-NH2 | 396 | | 1785.02 | 894.01 | 1786.03 | 893.52 | 596.01 |
| SP388 | Ac-LTF$r8AYAmWAQL$AANleA-NH2 | 397 | iso2 | 1785.02 | 894.01 | 1786.03 | 893.52 | 596.01 |
| SP389 | Ac-LTF$r8AYWAibQL$AANleA-NH2 | 398 | | 1785.02 | 894.01 | 1786.03 | 893.52 | 596.01 |
| SP390 | Ac-LTF$r8AYWAibQL$AANleA-NH2 | 399 | iso2 | 1785.02 | 894.01 | 1786.03 | 893.52 | 596.01 |
| SP391 | Ac-LTF$r8AYWAQL$AAibNleA-NH2 | 400 | | 1785.02 | 894.38 | 1786.03 | 893.52 | 596.01 |
| SP392 | Ac-LTF$r8AYWAQL$AAibNleA-NH2 | 401 | iso2 | 1785.02 | 894.38 | 1786.03 | 893.52 | 596.01 |
| SP393 | Ac-LTF$r8AYWAQL$AaNleA-NH2 | 402 | | 1771.01 | 887.54 | 1772.02 | 886.51 | 591.34 |
| SP394 | Ac-LTF$r8AYWAQL$AaNleA-NH2 | 403 | iso2 | 1771.01 | 887.54 | 1772.02 | 886.51 | 591.34 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP395 | Ac-LTF$r8AYWAQL$ASarNleA-NH2 | 404 | | 1771.01 | 887.35 | 1772.02 | 886.51 | 591.34 |
| SP396 | Ac-LTF$r8AYWAQL$ASarNleA-NH2 | 405 | iso2 | 1771.01 | 887.35 | 1772.02 | 886.51 | 591.34 |
| SP397 | Ac-LTF$r8AYWAQL$AANleAib-NH2 | 406 | | 1785.02 | 894.75 | 1786.03 | 893.52 | 596.01 |
| SP398 | Ac-LTF$r8AYWAQL$AANleAib-NH2 | 407 | iso2 | 1785.02 | 894.75 | 1786.03 | 893.52 | 596.01 |
| SP399 | Ac-LTF$r8AYWAQL$AANleNmA-NH2 | 408 | | 1785.02 | 894.6 | 1786.03 | 893.52 | 596.01 |
| SP400 | Ac-LTF$r8AYWAQL$AANleNmA-NH2 | 409 | iso2 | 1785.02 | 894.6 | 1786.03 | 893.52 | 596.01 |
| SP401 | Ac-LTF$r8AYWAQL$AANleSar-NH2 | 410 | | 1771.01 | 886.98 | 1772.02 | 886.51 | 591.34 |
| SP402 | Ac-LTF$r8AYWAQL$AANleSar-NH2 | 411 | iso2 | 1771.01 | 886.98 | 1772.02 | 886.51 | 591.34 |
| SP403 | Ac-LTF$r8AYWAQL$AANleAAib-NH2 | 412 | | 1856.06 | | 1857.07 | 929.04 | 619.69 |
| SP404 | Ac-LTF$r8AYWAQL$AANleAAib-NH2 | 413 | iso2 | 1856.06 | | 1857.07 | 929.04 | 619.69 |
| SP405 | Ac-LTF$r8AYWAQL$AANleANmA-NH2 | 414 | | 1856.06 | 930.37 | 1857.07 | 929.04 | 619.69 |
| SP406 | Ac-LTF$r8AYWAQL$AANleANmA-NH2 | 415 | iso2 | 1856.06 | 930.37 | 1857.07 | 929.04 | 619.69 |
| SP407 | Ac-LTF$r8AYWAQL$AANleAa-NH2 | 416 | | 1842.04 | 922.69 | 1843.05 | 922.03 | 615.02 |
| SP408 | Ac-LTF$r8AYWAQL$AANleAa-NH2 | 417 | iso2 | 1842.04 | 922.69 | 1843.05 | 922.03 | 615.02 |
| SP409 | Ac-LTF$r8AYWAQL$AANleASar-NH2 | 418 | | 1842.04 | 922.6 | 1843.05 | 922.03 | 615.02 |
| SP410 | Ac-LTF$r8AYWAQL$AANleASar-NH2 | 419 | iso2 | 1842.04 | 922.6 | 1843.05 | 922.03 | 615.02 |
| SP411 | Ac-LTF$/r8AYWAQL$/AANleA-NH2 | 420 | | 1799.04 | 901.14 | 1800.05 | 900.53 | 600.69 |
| SP412 | Ac-LTFAibAYWAQLAibAANleA-NH2 | 421 | | 1648.9 | 826.02 | 1649.91 | 825.46 | 550.64 |
| SP413 | Ac-LTF$r8Cou4YWAQL$AANleA-NH2 | 422 | | 1975.05 | 989.11 | 1976.06 | 988.53 | 659.36 |
| SP414 | Ac-LTF$r8Cou4YWAQL$AANleA-NH2 | 423 | iso2 | 1975.05 | 989.11 | 1976.06 | 988.53 | 659.36 |
| SP415 | Ac-LTF$r8AYWCou4QL$AANleA-NH2 | 424 | | 1975.05 | 989.11 | 1976.06 | 988.53 | 659.36 |
| SP416 | Ac-LTF$r8AYWAQL$Cou4ANleA-NH2 | 425 | | 1975.05 | 989.57 | 1976.06 | 988.53 | 659.36 |
| SP417 | Ac-LTF$r8AYWAQL$Cou4ANleA-NH2 | 426 | iso2 | 1975.05 | 989.57 | 1976.06 | 988.53 | 659.36 |
| SP418 | Ac-LTF$r8AYWAQL$ACou4NleA-NH2 | 427 | | 1975.05 | 989.57 | 1976.06 | 988.53 | 659.36 |
| SP419 | Ac-LTF$r8AYWAQL$ACou4NleA-NH2 | 428 | iso2 | 1975.05 | 989.57 | 1976.06 | 988.53 | 659.36 |
| SP420 | Ac-LTF$r8AYWAQL$AANleA-OH | 429 | | 1771.99 | 887.63 | 1773 | 887 | 591.67 |
| SP421 | Ac-LTF$r8AYWAQL$AANleA-OH | 430 | iso2 | 1771.99 | 887.63 | 1773 | 887 | 591.67 |
| SP422 | Ac-LTF$r8AYWAQL$AANleA-NHnPr | 431 | | 1813.05 | 908.08 | 1814.06 | 907.53 | 605.36 |
| SP423 | Ac-LTF$r8AYWAQL$AANleA-NHnPr | 432 | iso2 | 1813.05 | 908.08 | 1814.06 | 907.53 | 605.36 |
| SP424 | Ac-LTF$r8AYWAQL$AANleA-NHnBu33Me | 433 | | 1855.1 | 929.17 | 1856.11 | 928.56 | 619.37 |
| SP425 | Ac-LTF$r8AYWAQL$AANleA-NHnBu33Me | 434 | iso2 | 1855.1 | 929.17 | 1856.11 | 928.56 | 619.37 |
| SP426 | Ac-LTF$r8AYWAQL$AANleA-NHHex | 435 | | 1855.1 | 929.17 | 1856.11 | 928.56 | 619.37 |
| SP427 | Ac-LTF$r8AYWAQL$AANleA-NHHex | 436 | iso2 | 1855.1 | 929.17 | 1856.11 | 928.56 | 619.37 |
| SP428 | Ac-LTA$r8AYWAQL$AANleA-NH2 | 437 | | 1694.98 | 849.33 | 1695.99 | 848.5 | 566 |
| SP429 | Ac-LThL$r8AYWAQL$AANleA-NH2 | 438 | | 1751.04 | 877.09 | 1752.05 | 876.53 | 584.69 |
| SP430 | Ac-LTF$r8AYAAQL$AANleA-NH2 | 439 | | 1655.97 | 829.54 | 1656.98 | 828.99 | 553 |
| SP431 | Ac-LTF$r8AY2NalAQL$AANleA-NH2 | 440 | | 1782.01 | 892.63 | 1783.02 | 892.01 | 595.01 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP432 | Ac-LTF$r8EYWCou4QCba$SAA-NH2 | 441 | | 1947.97 | 975.8 | 1948.98 | 974.99 | 650.33 |
| SP433 | Ac-LTF$r8EYWCou7QCba$SAA-NH2 | 442 | | 16.03 | 974.9 | 17.04 | 9.02 | 6.35 |
| SP434 | Ac-LTF%r8EYWAQCba%SAA-NH2 | 443 | | 1745.94 | 874.8 | 1746.95 | 873.98 | 582.99 |
| SP435 | Dmaac-LTF$r8EYWAQCba$SAA-NH2 | 444 | | 1786.97 | 894.8 | 1787.98 | 894.49 | 596.66 |
| SP436 | Dmaac-LTF$r8AYWAQL$AAAAAa-NH2 | 445 | | 1914.08 | 958.2 | 1915.09 | 958.05 | 639.03 |
| SP437 | Dmaac-LTF$r8AYWAQL$AAAAAa-NH2 | 446 | iso2 | 1914.08 | 958.2 | 1915.09 | 958.05 | 639.03 |
| SP438 | Dmaac-LTF$r8EYWAQL$AAAAAa-NH2 | 447 | | 1972.08 | 987.3 | 1973.09 | 987.05 | 658.37 |
| SP439 | Dmaac-LTF$r8EYWAQL$AAAAAa-NH2 | 448 | iso2 | 1972.08 | 987.3 | 1973.09 | 987.05 | 658.37 |
| SP440 | Dmaac-LTF$r8EF4coohWAQCba$AAIa-NH2 | 449 | | 1912.05 | 957.4 | 1913.06 | 957.03 | 638.36 |
| SP441 | Dmaac-LTF$r8EF4coohWAQCba$AAIa-NH2 | 450 | iso2 | 1912.05 | 957.4 | 1913.06 | 957.03 | 638.36 |
| SP442 | Dmaac-LTF$r8AYWAQL$AANleA-NH2 | 451 | | 1814.05 | 908.3 | 1815.06 | 908.03 | 605.69 |
| SP443 | Dmaac-LTF$r8AYWAQL$AANleA-NH2 | 452 | iso2 | 1814.05 | 908.3 | 1815.06 | 908.03 | 605.69 |
| SP444 | Ac-LTF%r8AYWAQL%AANleA-NH2 | 453 | | 1773.02 | 888.37 | 1774.03 | 887.52 | 592.01 |
| SP445 | Ac-LTF%r8EYWAQL%AAAAAa-NH2 | 454 | | 1931.06 | 966.4 | 1932.07 | 966.54 | 644.69 |
| SP446 | Cou6BaLTF$r8EYWAQhL$SAA-NH2 | 455 | | 2018.05 | 1009.9 | 2019.06 | 1010.03 | 673.69 |
| SP447 | Cou8BaLTF$r8EYWAQhL$SAA-NH2 | 456 | | 1962.96 | 982.34 | 1963.97 | 982.49 | 655.32 |
| SP448 | Ac-LTF4I$r8EYWAQL$AAAAAa-NH2 | 457 | | 2054.93 | 1028.68 | 2055.94 | 1028.47 | 685.98 |
| SP449 | Ac-LTF$r8EYWAQL$AAAAAa-NH2 | 458 | | 1929.04 | 966.17 | 1930.05 | 965.53 | 644.02 |
| SP550 | Ac-LTF$r8EYWAQL$AAAAAa-OH | 459 | | 1930.02 | 966.54 | 1931.03 | 966.02 | 644.35 |
| SP551 | Ac-LTF$r8EYWAQL$AAAAAa-OH | 460 | iso2 | 1930.02 | 965.89 | 1931.03 | 966.02 | 644.35 |
| SP552 | Ac-LTF$r8EYWAEL$AAAAAa-NH2 | 461 | | 1930.02 | 966.82 | 1931.03 | 966.02 | 644.35 |
| SP553 | Ac-LTF$r8EYWAEL$AAAAAa-NH2 | 462 | iso2 | 1930.02 | 966.91 | 1931.03 | 966.02 | 644.35 |
| SP554 | Ac-LTF$r8EYWAEL$AAAAAa-OH | 463 | | 1931.01 | 967.28 | 1932.02 | 966.51 | 644.68 |
| SP555 | Ac-LTF$r8EY6clWAQL$AAAAAa-NH2 | 464 | | 1963 | 983.28 | 1964.01 | 982.51 | 655.34 |
| SP556 | Ac-LTF$r8EF4b0H2WAQL$AAAAAa-NH2 | 465 | | 1957.05 | 980.04 | 1958.06 | 979.53 | 653.36 |
| SP557 | Ac-AAALTF$r8EYWAQL$AAAAAa-NH2 | 466 | | 2142.15 | 1072.83 | 2143.16 | 1072.08 | 715.06 |
| SP558 | Ac-LTF34F2$r8EYWAQL$AAAAAa-NH2 | 467 | | 1965.02 | 984.3 | 1966.03 | 983.52 | 656.01 |
| SP559 | Ac-RTF$r8EYWAQL$AAAAAa-NH2 | 468 | | 1972.06 | 987.81 | 1973.07 | 987.04 | 658.36 |
| SP560 | Ac-LTA$r8EYWAQL$AAAAAa-NH2 | 469 | | 1853.01 | 928.33 | 1854.02 | 927.51 | 618.68 |
| SP561 | Ac-LTF$r8EYWAibQL$AAAAAa-NH2 | 470 | | 1943.06 | 973.48 | 1944.07 | 972.54 | 648.69 |
| SP562 | Ac-LTF$r8EYWAQL$AAibAAAa-NH2 | 471 | | 1943.06 | 973.11 | 1944.07 | 972.54 | 648.69 |
| SP563 | Ac-LTF$r8EYWAQL$AAAibAAa-NH2 | 472 | | 1943.06 | 973.48 | 1944.07 | 972.54 | 648.69 |
| SP564 | Ac-LTF$r8EYWAQL$AAAAibAa-NH2 | 473 | | 1943.06 | 973.48 | 1944.07 | 972.54 | 648.69 |
| SP565 | Ac-LTF$r8EYWAQL$AAAAAiba-NH2 | 474 | | 1943.06 | 973.38 | 1944.07 | 972.54 | 648.69 |
| SP566 | Ac-LTF$r8EYWAQL$AAAAAiba-NH2 | 475 | iso2 | 1943.06 | 973.38 | 1944.07 | 972.54 | 648.69 |
| SP567 | Ac-LTF$r8EYWAQL$AAAAAAib-NH2 | 476 | | 1943.06 | 973.01 | 1944.07 | 972.54 | 648.69 |
| SP568 | Ac-LTF$r8EYWAQL$AaAAAa-NH2 | 477 | | 1929.04 | 966.54 | 1930.05 | 965.53 | 644.02 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP569 | Ac-LTF$r8EYWAQL$AAaAAa-NH2 | 478 | | 1929.04 | 966.35 | 1930.05 | 965.53 | 644.02 |
| SP570 | Ac-LTF$r8EYWAQL$AAAaAa-NH2 | 479 | | 1929.04 | 966.54 | 1930.05 | 965.53 | 644.02 |
| SP571 | Ac-LTF$r8EYWAQL$AAAaAa-NH2 | 480 | iso2 | 1929.04 | 966.35 | 1930.05 | 965.53 | 644.02 |
| SP572 | Ac-LTF$r8EYWAQL$AAAAaa-NH2 | 481 | | 1929.04 | 966.35 | 1930.05 | 965.53 | 644.02 |
| SP573 | Ac-LTF$r8EYWAQL$AAAAAA-NH2 | 482 | | 1929.04 | 966.35 | 1930.05 | 965.53 | 644.02 |
| SP574 | Ac-LTF$r8EYWAQL$ASarAAAa-NH2 | 483 | | 1929.04 | 966.54 | 1930.05 | 965.53 | 644.02 |
| SP575 | Ac-LTF$r8EYWAQL$AASarAAa-NH2 | 484 | | 1929.04 | 966.35 | 1930.05 | 965.53 | 644.02 |
| SP576 | Ac-LTF$r8EYWAQL$AAASarAa-NH2 | 485 | | 1929.04 | 966.35 | 1930.05 | 965.53 | 644.02 |
| SP577 | Ac-LTF$r8EYWAQL$AAAASara-NH2 | 486 | | 1929.04 | 966.35 | 1930.05 | 965.53 | 644.02 |
| SP578 | Ac-LTF$r8EYWAQL$AAAAASar-NH2 | 487 | | 1929.04 | 966.08 | 1930.05 | 965.53 | 644.02 |
| SP579 | Ac-7LTF$r8EYWAQL$AAAAAa-NH2 | 488 | | 1918.07 | 951.99 | 1919.08 | 960.04 | 640.37 |
| SP581 | Ac-TF$r8EYWAQL$AAAAAa-NH2 | 489 | | 1815.96 | 929.85 | 1816.97 | 908.99 | 606.33 |
| SP582 | Ac-F$r8EYWAQL$AAAAAa-NH2 | 490 | | 1714.91 | 930.92 | 1715.92 | 858.46 | 572.64 |
| SP583 | Ac-LVF$r8EYWAQL$AAAAAa-NH2 | 491 | | 1927.06 | 895.12 | 1928.07 | 964.54 | 643.36 |
| SP584 | Ac-AAF$r8EYWAQL$AAAAAa-NH2 | 492 | | 1856.98 | 859.51 | 1857.99 | 929.5 | 620 |
| SP585 | Ac-LTF$r8EYWAQL$AAAAa-NH2 | 493 | | 1858 | 824.08 | 1859.01 | 930.01 | 620.34 |
| SP586 | Ac-LTF$r8EYWAQL$AAAa-NH2 | 494 | | 1786.97 | 788.56 | 1787.98 | 894.49 | 596.66 |
| SP587 | Ac-LTF$r8EYWAQL$AAa-NH2 | 495 | | 1715.93 | 1138.57 | 1716.94 | 858.97 | 572.98 |
| SP588 | Ac-LTF$r8EYWAQL$Aa-NH2 | 496 | | 1644.89 | 1144.98 | 1645.9 | 823.45 | 549.3 |
| SP589 | Ac-LTF$r8EYWAQL$a-NH2 | 497 | | 1573.85 | 1113.71 | 1574.86 | 787.93 | 525.62 |
| SP590 | Ac-LTF$r8EYWAQL$AAA-OH | 498 | | 1716.91 | 859.55 | 1717.92 | 859.46 | 573.31 |
| SP591 | Ac-LTF$r8EYWAQL$A-OH | 499 | | 1574.84 | 975.14 | 1575.85 | 788.43 | 525.95 |
| SP592 | Ac-LTF$r8EYWAQL$AAA-NH2 | 500 | | 1715.93 | 904.75 | 1716.94 | 858.97 | 572.98 |
| SP593 | Ac-LTF$r8EYWAQCba$SAA-OH | 501 | | 1744.91 | 802.49 | 1745.92 | 873.46 | 582.64 |
| SP594 | Ac-LTF$r8EYWAQCba$S-OH | 502 | | 1602.83 | 913.53 | 1603.84 | 802.42 | 535.28 |
| SP595 | Ac-LTF$r8EYWAQCba$S-NH2 | 503 | | 1601.85 | 979.58 | 1602.86 | 801.93 | 534.96 |
| SP596 | 4-FBzl-LTF$r8EYWAQL$AAAAAa-NH2 | 504 | | 2009.05 | 970.52 | 2010.06 | 1005.53 | 670.69 |
| SP597 | 4-FBzl-LTF$r8EYWAQCba$SAA-NH2 | 505 | | 1823.93 | 965.8 | 1824.94 | 912.97 | 608.98 |
| SP598 | Ac-LTF$r8RYWAQL$AAAAAa-NH2 | 506 | | 1956.1 | 988.28 | 1957.11 | 979.06 | 653.04 |
| SP599 | Ac-LTF$r8HYWAQL$AAAAAa-NH2 | 507 | | 1937.06 | 1003.54 | 1938.07 | 969.54 | 646.69 |
| SP600 | Ac-LTF$r8QYWAQL$AAAAAa-NH2 | 508 | | 1928.06 | 993.92 | 1929.07 | 965.04 | 643.69 |
| SP601 | Ac-LTF$r8CitYWAQL$AAAAAa-NH2 | 509 | | 1957.08 | 987 | 1958.09 | 979.55 | 653.37 |
| SP602 | Ac-LTF$r8GlaYWAQL$AAAAAa-NH2 | 510 | | 1973.03 | 983 | 1974.04 | 987.52 | 658.68 |
| SP603 | Ac-LTF$r8F4gYWAQL$AAAAAa-NH2 | 511 | | 2004.1 | 937.86 | 2005.11 | 1003.06 | 669.04 |
| SP604 | Ac-LTF$r82mRYWAQL$AAAAAa-NH2 | 512 | | 1984.13 | 958.58 | 1985.14 | 993.07 | 662.38 |
| SP605 | Ac-LTF$r8ipKYWAQL$AAAAAa-NH2 | 513 | | 1970.14 | 944.52 | 1971.15 | 986.08 | 657.72 |
| SP606 | Ac-LTF$r8F4NH2YWAQL$AAAAAa-NH2 | 514 | | 1962.08 | 946 | 1963.09 | 982.05 | 655.03 |
| SP607 | Ac-LTF$r8EYWAAL$AAAAAa-NH2 | 515 | | 1872.02 | 959.32 | 1873.03 | 937.02 | 625.01 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP608 | Ac-LTF$r8EYWALL$AAAAAa-NH2 | 516 | | 1914.07 | 980.88 | 1915.08 | 958.04 | 639.03 |
| SP609 | Ac-LTF$r8EYWAAibL$AAAAAa-NH2 | 517 | | 1886.03 | 970.61 | 1887.04 | 944.02 | 629.68 |
| SP610 | Ac-LTF$r8EYWASL$AAAAAa-NH2 | 518 | | 1888.01 | 980.51 | 1889.02 | 945.01 | 630.34 |
| SP611 | Ac-LTF$r8EYWANL$AAAAAa-NH2 | 519 | | 1915.02 | 1006.41 | 1916.03 | 958.52 | 639.35 |
| SP612 | Ac-LTF$r8EYWACitL$AAAAAa-NH2 | 520 | | 1958.07 | | 1959.08 | 980.04 | 653.7 |
| SP613 | Ac-LTF$r8EYWAHL$AAAAAa-NH2 | 521 | | 1938.04 | 966.24 | 1939.05 | 970.03 | 647.02 |
| SP614 | Ac-LTF$r8EYWARL$AAAAAa-NH2 | 522 | | 1957.08 | | 1958.09 | 979.55 | 653.37 |
| SP615 | Ac-LTF$r8EpYWAQL$AAAAAa-NH2 | 523 | | 2009.01 | | 2010.02 | 1005.51 | 670.68 |
| SP616 | Cbm-LTF$r8EYWAQCba$SAA-NH2 | 524 | | 1590.85 | | 1591.86 | 796.43 | 531.29 |
| SP617 | Cbm-LTF$r8EYWAQL$AAAAAa-NH2 | 525 | | 1930.04 | | 1931.05 | 966.03 | 644.35 |
| SP618 | Ac-LTF$r8EYWAQL$SAAAAa-NH2 | 526 | | 1945.04 | 1005.11 | 1946.05 | 973.53 | 649.35 |
| SP619 | Ac-LTF$r8EYWAQL$AAAASa-NH2 | 527 | | 1945.04 | 986.52 | 1946.05 | 973.53 | 649.35 |
| SP620 | Ac-LTF$r8EYWAQL$SAASa-NH2 | 528 | | 1961.03 | 993.27 | 1962.04 | 981.52 | 654.68 |
| SP621 | Ac-LTF$r8EYWAQTba$AAAAAa-NH2 | 529 | | 1943.06 | 983.1 | 1944.07 | 972.54 | 648.69 |
| SP622 | Ac-LTF$r8EYWAQdm$AAAAAa-NH2 | 530 | | 2007.09 | 990.31 | 2008.1 | 1004.55 | 670.04 |
| SP623 | Ac-LTF$r8EYWAQCha$AAAAAa-NH2 | 531 | | 1969.07 | 987.17 | 1970.08 | 985.54 | 657.36 |
| SP624 | Ac-LTF$r8EYWAQhCha$AAAAAa-NH2 | 532 | | 1983.09 | 1026.11 | 1984.1 | 992.55 | 662.04 |
| SP625 | Ac-LTF$r8EYWAQF$AAAAAa-NH2 | 533 | | 1963.02 | 957.01 | 1964.03 | 982.52 | 655.35 |
| SP626 | Ac-LTF$r8EYWAQhF$AAAAAa-NH2 | 534 | | 1977.04 | 1087.81 | 1978.05 | 989.53 | 660.02 |
| SP627 | Ac-LTF$r8EYWAQL$AANleAAa-NH2 | 535 | | 1971.09 | 933.45 | 1972.1 | 986.55 | 658.04 |
| SP628 | Ac-LTF$r8EYWAQdm$AANleAAa-NH2 | 536 | | 2049.13 | 1017.97 | 2050.14 | 1025.57 | 684.05 |
| SP629 | 4-FBz-BaLTF$r8EYWAQL$AAAAAa-NH2 | 537 | | 2080.08 | | 2081.09 | 1041.05 | 694.37 |
| SP630 | 4-FBz-BaLTF$r8EYWAQCba$SAA-NH2 | 538 | | 1894.97 | | 1895.98 | 948.49 | 632.66 |
| SP631 | Ac-LTF$r5EYWAQL$s8AAAAAa-NH2 | 539 | | 1929.04 | 1072.68 | 1930.05 | 965.53 | 644.02 |
| SP632 | Ac-LTF$r5EYWAQCba$s8SAA-NH2 | 540 | | 1743.92 | 1107.79 | 1744.93 | 872.97 | 582.31 |
| SP633 | Ac-LTF$r8EYWAQL$AAhhLAAa-NH2 | 541 | | 1999.12 | | 2000.13 | 1000.57 | 667.38 |
| SP634 | Ac-LTF$r8EYWAQL$AAAAAAa-NH2 | 542 | | 2071.11 | | 2072.12 | 1036.56 | 691.38 |
| SP635 | Ac-LTF$r8EYWAQL$AAAAAAAa-NH2 | 543 | | 2142.15 | 778.1 | 2143.16 | 1072.08 | 715.06 |
| SP636 | Ac-LTF$r8EYWAQL$AAAAAAAAa-NH2 | 544 | | 2213.19 | 870.53 | 2214.2 | 1107.6 | 738.74 |
| SP637 | Ac-LTA$r8EYAAQCba$SAA-NH2 | 545 | | 1552.85 | | 1553.86 | 777.43 | 518.62 |
| SP638 | Ac-LTA$r8EYAAQL$AAAAAa-NH2 | 546 | | 1737.97 | 779.45 | 1738.98 | 869.99 | 580.33 |
| SP639 | Ac-LTF$r8EPmpWAQL$AAAAAa-NH2 | 547 | | 2007.03 | 779.54 | 2008.04 | 1004.52 | 670.02 |
| SP640 | Ac-LTF$r8EPmpWAQCba$SAA-NH2 | 548 | | 1821.91 | 838.04 | 1822.92 | 911.96 | 608.31 |
| SP641 | Ac-ATF$r8HYWAQL$S-NH2 | 549 | | 1555.82 | 867.83 | 1556.83 | 778.92 | 519.61 |
| SP642 | Ac-LTF$r8HAWAQL$S-NH2 | 550 | | 1505.84 | 877.91 | 1506.85 | 753.93 | 502.95 |
| SP643 | Ac-LTF$r8HYWAQA$S-NH2 | 551 | | 1555.82 | 852.52 | 1556.83 | 778.92 | 519.61 |
| SP644 | Ac-LTF$r8EYWAQCba$SA-NH2 | 552 | | 1672.89 | 887.18 | 1673.9 | 837.45 | 558.64 |
| SP645 | Ac-LTF$r8EYWAQL$SAA-NH2 | 553 | | 1731.92 | 873.32 | 1732.93 | 866.97 | 578.31 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP646 | Ac-LTF$r8HYWAQCba$SAA-NH2 | 554 | | 1751.94 | 873.05 | 1752.95 | 876.98 | 584.99 |
| SP647 | Ac-LTF$r8SYWAQCba$SAA-NH2 | 555 | | 1701.91 | 844.88 | 1702.92 | 851.96 | 568.31 |
| SP648 | Ac-LTF$r8RYWAQCba$SAA-NH2 | 556 | | 1770.98 | 865.58 | 1771.99 | 886.5 | 591.33 |
| SP649 | Ac-LTF$r8KYWAQCba$SAA-NH2 | 557 | | 1742.98 | 936.57 | 1743.99 | 872.5 | 582 |
| SP650 | Ac-LTF$r8QYWAQCba$SAA-NH2 | 558 | | 1742.94 | 930.93 | 1743.95 | 872.48 | 581.99 |
| SP651 | Ac-LTF$r8EYWAACba$SAA-NH2 | 559 | | 1686.9 | 1032.45 | 1687.91 | 844.46 | 563.31 |
| SP652 | Ac-LTF$r8EYWAQCba$AAA-NH2 | 560 | | 1727.93 | 895.46 | 1728.94 | 864.97 | 576.98 |
| SP653 | Ac-LTF$r8EYWAQL$AAAAA-OH | 561 | | 1858.99 | 824.54 | 1860 | 930.5 | 620.67 |
| SP654 | Ac-LTF$r8EYWAQL$AAAA-OH | 562 | | 1787.95 | 894.48 | 1788.96 | 894.98 | 596.99 |
| SP655 | Ac-LTF$r8EYWAQL$AA-OH | 563 | | 1645.88 | 856 | 1646.89 | 823.95 | 549.63 |
| SP656 | Ac-LTF$r8AF4bOH2WAQL$AAAAAa-NH2 | 564 | | | | | | |
| SP657 | Ac-LTF$r8AF4bOH2WAAL$AAAAAa-NH2 | 565 | | | | | | |
| SP658 | Ac-LTF$r8EF4bOH2WAQCba$SAA-NH2 | 566 | | | | | | |
| SP659 | Ac-LTF$r8ApYWAQL$AAAAAa-NH2 | 567 | | | | | | |
| SP660 | Ac-LTF$r8ApYWAALSAAAAAa-NH2 | 568 | | | | | | |
| SP661 | Ac-LTF$r8EpYWAQCba$SAA-NH2 | 569 | | | | | | |
| SP662 | Ac-LTF$rda6AYWAQL$da5AAAAAa-NH2 | 570 | | 1974.06 | 934.44 | | | |
| SP663 | Ac-LTF$rda6EYWAQCba$da5SAA-NH2 | 571 | | 1846.95 | 870.52 | | 869.94 | |
| SP664 | Ac-LTF$rda6EYWAQL$da5AAAAAa-NH2 | 572 | | | | | | |
| SP665 | Ac-LTF$ra9EYWAQL$a6AAAAAa-NH2 | 573 | | | 936.57 | | 935.51 | |
| SP666 | Ac-LTF$ra9EYWAQL$a6AAAAAa-NH2 | 574 | | | | | | |
| SP667 | Ac-LTF$ra9EYWAQCba$a6SAA-NH2 | 575 | | | | | | |
| SP668 | Ac-LTA$ra9EYWAQCba$a6SAA-NH2 | 576 | | | | | | |
| SP669 | 5-FAM-BaLTF$ra9EYWAQCba$a6SAA-NH2 | 577 | | | | | | |
| SP670 | 5-FAM-BaLTF$r8EYWAQL$AAAAAa-NH2 | 578 | | 2316.11 | | | | |
| SP671 | 5-FAM-BaLTF$/r8EYWAQL$/AAAAAa-NH2 | 579 | | 2344.15 | | | | |
| SP672 | 5-FAM-BaLTA$r8EYWAQL$AAAAAa-NH2 | 580 | | 2240.08 | | | | |
| SP673 | 5-FAM-BaLTF$r8AYWAQL$AAAAAa-NH2 | 581 | | 2258.11 | | | | |
| SP674 | 5-FAM-BaATF$r8EYWAQL$AAAAAa-NH2 | 582 | | 2274.07 | | | | |
| SP675 | 5-FAM-BaLAF$r8EYWAQL$AAAAAa-NH2 | 583 | | 2286.1 | | | | |
| SP676 | 5-FAM-BaLTF$r8EAWAQL$AAAAAa-NH2 | 584 | | 2224.09 | | | | |
| SP677 | 5-FAM-BaLTF$r8EYAAQL$AAAAAa-NH2 | 585 | | 2201.07 | | | | |
| SP678 | 5-FAM-BaLTA$r8EYAAQL$AAAAAa-NH2 | 586 | | 2125.04 | | | | |
| SP679 | 5-FAM-BaLTF$r8EYWAAL$AAAAAa-NH2 | 587 | | 2259.09 | | | | |
| SP680 | 5-FAM-BaLTF$r8EYWAQA$AAAAAa-NH2 | 588 | | 2274.07 | | | | |
| SP681 | 5-FAM-BaLTF$/r8EYWAQCba$/SAA-NH2 | 589 | | 2159.03 | | | | |
| SP682 | 5-FAM-BaLTA$r8EYWAQCba$SAA-NH2 | 590 | | 2054.97 | | | | |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP683 | 5-FAM-BaLTF$r8EYAAQCba$SAA-NH2 | 591 | | 2015.96 | | | | |
| SP684 | 5-FAM-BaLTA$r8EYAAQCba$SAA-NH2 | 592 | | 1939.92 | | | | |
| SP685 | 5-FAM-BaQSQQTF$r8NLWRLL$QN-NH2 | 593 | | 2495.23 | | | | |
| SP686 | 5-TAMRA-BaLTF$r8EYWAQCba$SAA-NH2 | 594 | | 2186.1 | | | | |
| SP687 | 5-TAMRA-BaLTA$r8EYWAQCba$SAA-NH2 | 595 | | 2110.07 | | | | |
| SP688 | 5-TAMRA-BaLTF$r8EYAAQCba$SAA-NH2 | 596 | | 2071.06 | | | | |
| SP689 | 5-TAMRA-BaLTA$r8EYAAQCba$SAA-NH2 | 597 | | 1995.03 | | | | |
| SP690 | 5-TAMRA-BaLTF$/r8EYWAQCba$/SAA-NH2 | 598 | | 2214.13 | | | | |
| SP691 | 5-TAMRA-BaLTF$r8EYWAQL$AAAAAa-NH2 | 599 | | 2371.22 | | | | |
| SP692 | 5-TAMRA-BaLTA$r8EYWAQL$AAAAAa-NH2 | 600 | | 2295.19 | | | | |
| SP693 | 5-TAMRA-BaLTF$/r8EYWAQL$/AAAAAa-NH2 | 601 | | 2399.25 | | | | |
| SP694 | Ac-LTF$r8EYWCou7QCba$SAA-OH | 602 | | 1947.93 | | | | |
| SP695 | Ac-LTF$r8EYWCou7QCba$S-OH | 603 | | 1805.86 | | | | |
| SP696 | Ac-LTA$r8EYWCou7QCba$SAA-NH2 | 604 | | 1870.91 | | | | |
| SP697 | Ac-LTF$r8EYACou7QCba$SAA-NH2 | 605 | | 1831.9 | | | | |
| SP698 | Ac-LTA$r8EYACou7QCba$SAA-NH2 | 606 | | 1755.87 | | | | |
| SP699 | Ac-LTF$/r8EYWCou7QCba$/SAA-NH2 | 607 | | 1974.98 | | | | |
| SP700 | Ac-LTF$r8EYWCou7QL$AAAAAa-NH2 | 608 | | 2132.06 | | | | |
| SP701 | Ac-LTF$/r8EYWCou7QL$/AAAAAa-NH2 | 609 | | 2160.09 | | | | |
| SP702 | Ac-LTF$r8EYWCou7QL$AAAAA-OH | 610 | | 2062.01 | | | | |
| SP703 | Ac-LTF$r8EYWCou7QL$AAAA-OH | 611 | | 1990.97 | | | | |
| SP704 | Ac-LTF$r8EYWCou7QL$AAA-OH | 612 | | 1919.94 | | | | |
| SP705 | Ac-LTF$r8EYWCou7QL$AA-OH | 613 | | 1848.9 | | | | |
| SP706 | Ac-LTF$r8EYWCou7QL$A-OH | 614 | | 1777.86 | | | | |
| SP707 | Ac-LTF$r8EYWAQL$AAAASa-NH2 | 615 | iso2 | | 974.4 | | 973.53 | |
| SP708 | Ac-LTF$r8AYWAAL$AAAAAa-NH2 | 616 | iso2 | 1814.01 | 908.82 | 1815.02 | 908.01 | 605.68 |
| SP709 | Biotin-BaLTF$r8EYWAQL$AAAAAa-NH2 | 617 | | 2184.14 | 1093.64 | 2185.15 | 1093.08 | 729.05 |
| SP710 | Ac-LTF$r8HAWAQL$S-NH2 | 618 | iso2 | 1505.84 | 754.43 | 1506.85 | 753.93 | 502.95 |
| SP711 | Ac-LTF$r8EYWAQCba$SA-NH2 | 619 | iso2 | 1672.89 | 838.05 | 1673.9 | 837.45 | 558.64 |
| SP712 | Ac-LTF$r8HYWAQCba$SAA-NH2 | 620 | iso2 | 1751.94 | 877.55 | 1752.95 | 876.98 | 584.99 |
| SP713 | Ac-LTF$r8SYWAQCba$SAA-NH2 | 621 | iso2 | 1701.91 | 852.48 | 1702.92 | 851.96 | 568.31 |
| SP714 | Ac-LTF$r8RYWAQCba$SAA-NH2 | 622 | iso2 | 1770.98 | 887.45 | 1771.99 | 886.5 | 591.33 |
| SP715 | Ac-LTF$r8KYWAQCba$SAA-NH2 | 623 | iso2 | 1742.98 | 872.92 | 1743.99 | 872.5 | 582 |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP716 | Ac-LTF$r8EYWAQCba$AAA-NH2 | 624 | iso2 | 1727.93 | 865.71 | 1728.94 | 864.97 | 576.98 |
| SP717 | Ac-LTF$r8EYWAQL$AAAAAaBaC-NH2 | 625 | | 2103.09 | 1053.12 | 2104.1 | 1052.55 | 702.04 |
| SP718 | Ac-LTF$r8EYWAQL$AAAAAadPeg4CNH2 | 626 | | 2279.19 | 1141.46 | 2280.2 | 1140.6 | 760.74 |
| SP719 | Ac-LTA$r8AYWAAL$AAAAAa-NH2 | 627 | | 1737.98 | 870.43 | 1738.99 | 870 | 580.33 |
| SP720 | Ac-LTF$r8AYAAAL$AAAAAa-NH2 | 628 | | 1698.97 | 851 | 1699.98 | 850.49 | 567.33 |
| SP721 | 5-FAM-BaLTF$r8AYWAAL$AAAAAa-NH2 | 629 | | 2201.09 | 1101.87 | 2202.1 | 1101.55 | 734.7 |
| SP722 | Ac-LTA$r8AYWAQL$AAAAAa-NH2 | 630 | | 1795 | 898.92 | 1796.01 | 898.51 | 599.34 |
| SP723 | Ac-LTF$r8AYAAQL$AAAAAa-NH2 | 631 | | 1755.99 | 879.49 | 1757 | 879 | 586.34 |
| SP724 | Ac-LTF$rda6AYWAAL$da5AAAAa-NH2 | 632 | | 1807.97 | | 1808.98 | 904.99 | 603.66 |
| SP725 | FITC-BaLTF$r8EYWAQL$AAAAAa-NH2 | 633 | | 2347.1 | 1174.49 | 2348.11 | 1174.56 | 783.37 |
| SP726 | FITC-BaLTF$r8EYWAQCba$SAA-NH2 | 634 | | 2161.99 | 1082.35 | 2163 | 1082 | 721.67 |
| SP733 | Ac-LTF$r8EYWAQL$EAAAa-NH2 | 635 | | 1987.05 | 995.03 | 1988.06 | 994.53 | 663.36 |
| SP734 | Ac-LTF$r8AYWAQL$EAAAa-NH2 | 636 | | 1929.04 | 966.35 | 1930.05 | 965.53 | 644.02 |
| SP735 | Ac-LTF$r8EYWAQL$AAAAAaBaKblo-NH2 | 637 | | 2354.25 | 1178.47 | 2355.26 | 1178.13 | 785.76 |
| SP736 | Ac-LTF$r8AYWAAL$AAAAAa-NH2 | 638 | | 1814.01 | 908.45 | 1815.02 | 908.01 | 605.68 |
| SP737 | Ac-LTF$r8AYAAAL$AAAAAa-NH2 | 639 | iso2 | 1698.97 | 850.91 | 1699.98 | 850.49 | 567.33 |
| SP738 | Ac-LTF$r8AYAAQL$AAAAAa-NH2 | 640 | iso2 | 1755.99 | 879.4 | 1757 | 879 | 586.34 |
| SP739 | Ac-LTF$r8EYWAQL$EAAAa-NH2 | 641 | iso2 | 1987.05 | 995.21 | 1988.06 | 994.53 | 663.36 |
| SP740 | Ac-LTF$r8AYWAQL$EAAAa-NH2 | 642 | iso2 | 1929.04 | 966.08 | 1930.05 | 965.53 | 644.02 |
| SP741 | Ac-LTF$r8EYWAQCba$SAAAAa-NH2 | 643 | | 1957.04 | 980.04 | 1958.05 | 979.53 | 653.35 |
| SP742 | Ac-LTF$r8EYWAQLStAAA$r5AA-NH2 | 644 | | 2023.12 | 1012.83 | 2024.13 | 1012.57 | 675.38 |
| SP743 | Ac-LTF$r8EYWAQL$A$AAA$A-NH2 | 645 | | 2108.17 | 1055.44 | 2109.18 | 1055.09 | 703.73 |
| SP744 | Ac-LTF$r8EYWAQL$AA$AAA$A-NH2 | 646 | | 2179.21 | 1090.77 | 2180.22 | 1090.61 | 727.41 |
| SP745 | Ac-LTF$r8EYWAQL$AAA$AAA$A-NH2 | 647 | | 2250.25 | 1126.69 | 2251.26 | 1126.13 | 751.09 |
| SP746 | Ac-AAALTF$r8EYWAQL$AAA-OH | 648 | | 1930.02 | | 1931.03 | 966.02 | 644.35 |
| SP747 | Ac-AAALTF$r8EYWAQL$AAA-NH2 | 649 | | 1929.04 | 965.85 | 1930.05 | 965.53 | 644.02 |
| SP748 | Ac-AAAALTF$r8EYWAQL$AAA-NH2 | 650 | | 2000.08 | 1001.4 | 2001.09 | 1001.05 | 667.7 |
| SP749 | Ac-AAAAALTF$r8EYWAQL$AAA-NH2 | 651 | | 2071.11 | 1037.13 | 2072.12 | 1036.56 | 691.38 |
| SP750 | Ac-AAAAAALTF$r8EYWAQL$AAA-NH2 | 652 | | 2142.15 | | 2143.16 | 1072.08 | 715.06 |
| SP751 | Ac-LTF$rda6EYWAQCba$da6SAA-NH2 | 653 | iso2 | 1751.89 | 877.36 | 1752.9 | 876.95 | 584.97 |
| SP752 | Ac-t$r5wya$r5f4CF3ekllr-NH2 | 654 | | 844.25 | | | | |
| SP753 | Ac-tawy$r5nf4CF3e$r5llr-NH2 | 655 | | 837.03 | | | | |
| SP754 | Ac-tawya$r5f4CF3ek$r5lr-NH2 | 656 | | 822.97 | | | | |
| SP755 | Ac-tawyanf4CF3e$r5llr$r5a-NH2 | 657 | | 908.35 | | | | |
| SP756 | Ac-t$s8wyanf4CF3e$r5llr-NH2 | 658 | | 858.03 | | | | |
| SP757 | Ac-tawy$s8nf4CF3ekll$r5a-NH2 | 659 | | 879.86 | | | | |
| SP758 | Ac-tawya$s8f4CF3ekllr$r5a-NH2 | 660 | | 936.38 | | | | |

TABLE 1-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP759 | Ac-tawy$s8naekll$r5a-NH2 | 661 | | 844.25 | | | | |
| SP760 | 5-FAM-Batawy$s8nf4CF3ekll$r5a-NH2 | 662 | | | | | | |
| SP761 | 5-FAM-Batawy$s8naekll$r5a-NH2 | 663 | | | | | | |
| SP762 | Ac-tawy$s8nf4CF3eall$r5a-NH2 | 664 | | | | | | |
| SP763 | Ac-tawy$s8nf4CF3ekll$r5aaaaa-NH2 | 665 | | | | | | |
| SP764 | Ac-tawy$s8nf4CF3eall$r5aaaaa-NH2 | 666 | | | | | | |

Table 1a shows a selection of peptidomimetic macrocycles.

TABLE 1a

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP244 | Ac-LTF$r8EF4coohWAQCba$SAN1eA-NH2 | 667 | | 1885 | 943.59 | 1886.01 | 943.51 | 629.34 |
| SP331 | Ac-LTF$r8EYWAQL$AAAAAa-NH2 | 668 | iso2 | 1929.04 | 966.08 | 1930.05 | 965.53 | 644.02 |
| SP555 | Ac-LTF$r8EY6clWAQL$AAAAAa-NH2 | 669 | | 1963 | 983.28 | 1964.01 | 982.51 | 655.34 |
| SP557 | Ac-AAALTF$r8EYWAQL$AAAAAa-NH2 | 670 | | 2142.15 | 1072.83 | 2143.16 | 1072.08 | 715.06 |
| SP558 | Ac-LTF34F2$r8EYWAQL$AAAAAa-NH2 | 671 | | 1965.02 | 984.3 | 1966.03 | 983.52 | 656.01 |
| SP562 | Ac-LTF$r8EYWAQL$AAibAAAa-NH2 | 672 | | 1943.06 | 973.11 | 1944.07 | 972.54 | 648.69 |
| SP564 | Ac-LTF$r8EYWAQL$AAAAibAa-NH2 | 673 | | 1943.06 | 973.48 | 1944.07 | 972.54 | 648.69 |
| SP566 | Ac-LTF$r8EYWAQL$AAAAAiba-NH2 | 674 | iso2 | 1943.06 | 973.38 | 1944.07 | 972.54 | 648.69 |
| SP567 | Ac-LTF$r8EYWAQL$AAAAAAib-NH2 | 675 | | 1943.06 | 973.01 | 1944.07 | 972.54 | 648.69 |
| SP572 | Ac-LTF$r8EYWAQL$AAAAaa-NH2 | 676 | | 1929.04 | 966.35 | 1930.05 | 965.53 | 644.02 |
| SP573 | Ac-LTF$r8EYWAQL$AAAAAA-NH2 | 677 | | 1929.04 | 966.35 | 1930.05 | 965.53 | 644.02 |
| SP578 | Ac-LTF$r8EYWAQL$AAAAASar-NH2 | 678 | | 1929.04 | 966.08 | 1930.05 | 965.53 | 644.02 |
| SP551 | Ac-LTF$r8EYWAQL$AAAAAa-OH | 679 | iso2 | 1930.02 | 965.89 | 1931.03 | 966.02 | 644.35 |
| SP662 | Ac-LTF$rda6AYWAQL$da5AAAAAa-NH2 | 680 | | 1974.06 | 934.44 | | 933.49 | |
| SP367 | 5-FAM-BaLTF$r8EYWAQCba$SAA-NH2 | 681 | | 2131 | 1067.09 | 2132.01 | 1066.51 | 711.34 |
| SP349 | Ac-LTF$r8EF4coohWAQCba$AAAAAa-NH2 | 682 | iso2 | 1969.04 | 986.06 | 1970.05 | 985.53 | 657.35 |
| SP347 | Ac-LTF$r8EYWAQCba$AAAAAa-NH2 | 683 | iso2 | 1941.04 | 972.55 | 1942.05 | 971.53 | 648.02 |

Table 1b shows a further selection of peptidomimetic macrocycles.

TABLE 1b

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP581 | Ac-TF$r8EYWAQL$AAAAAa-NH2 | 684 | | 1815.96 | 929.85 | 1816.97 | 908.99 | 606.33 |
| SP582 | Ac-F$r8EYWAQL$AAAAAa-NH2 | 685 | | 1714.91 | 930.92 | 1715.92 | 858.46 | 572.64 |
| SP583 | Ac-LVF$r8EYWAQL$AAAAAa-NH2 | 686 | | 1927.06 | 895.12 | 1928.07 | 964.54 | 643.36 |

TABLE 1b-continued

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP584 | Ac-AAF$r8EYWAQL$AAAAAa-NH2 | 687 | | 1856.98 | 859.51 | 1857.99 | 929.5 | 620 |
| SP585 | Ac-LTF$r8EYWAQL$AAAAa-NH2 | 688 | | 1858 | 824.08 | 1859.01 | 930.01 | 620.34 |
| SP586 | Ac-LTF$r8EYWAQL$AAAa-NH2 | 689 | | 1786.97 | 788.56 | 1787.98 | 894.49 | 596.66 |
| SP587 | Ac-LTF$r8EYWAQL$AAa-NH2 | 690 | | 1715.93 | 1138.57 | 1716.94 | 858.97 | 572.98 |
| SP588 | Ac-LTF$r8EYWAQL$Aa-NH2 | 691 | | 1644.89 | 1144.98 | 1645.9 | 823.45 | 549.3 |
| SP589 | Ac-LTF$r8EYWAQL$a-NH2 | 692 | | 1573.85 | 1113.71 | 1574.86 | 787.93 | 525.62 |

In the sequences shown above and elsewhere, the following abbreviations are used: "Nle" represents norleucine, "Aib" represents 2-aminoisobutyric acid, "Ac" represents acetyl, and "Pr" represents propionyl Amino acids represented as "$" are alpha-Me S5-pentenyl-alanine olefin amino acids connected by an all-carbon crosslinker comprising one double bond Amino acids represented as "$r5" are alpha-Me R5-pentenyl-alanine olefin amino acids connected by an all-carbon comprising one double bond Amino acids represented as "$s8" are alpha-Me S8-octenyl-alanine olefin amino acids connected by an all-carbon crosslinker comprising one double bond Amino acids represented as "$r8" are alpha-Me R8-octenyl-alanine olefin amino acids connected by an all-carbon crosslinker comprising one double bond. "Ahx" represents an aminocyclohexyl linker. The crosslinkers are linear all-carbon crosslinker comprising eight or eleven carbon atoms between the alpha carbons of each amino acid. Amino acids represented as "$/" are alpha-Me S5-pentenyl-alanine olefin amino acids that are not connected by any crosslinker Amino acids represented as "$/r5" are alpha-Me R5-pentenyl-alanine olefin amino acids that are not connected by any crosslinker Amino acids represented as "$/s8" are alpha-Me S8-octenyl-alanine olefin amino acids that are not connected by any crosslinker Amino acids represented as "$/r8" are alpha-Me R8-octenyl-alanine olefin amino acids that are not connected by any crosslinker. Amino acids represented as "Amw" are alpha-Me tryptophan amino acids Amino acids represented as "Aml" are alpha-Me leucine amino acids Amino acids represented as "Amf" are alpha-Me phenylalanine amino acids. Amino acids represented as "2ff" are 2-fluoro-phenylalanine amino acids. Amino acids represented as "3ff" are 3-fluoro-phenylalanine amino acids Amino acids represented as "St" are amino acids comprising two pentenyl-alanine olefin side chains, each of which is crosslinked to another amino acid as indicated Amino acids represented as "St//" are amino acids comprising two pentenyl-alanine olefin side chains that are not crosslinked Amino acids represented as "% St" are amino acids comprising two pentenyl-alanine olefin side chains, each of which is crosslinked to another amino acid as indicated via fully saturated hydrocarbon crosslinks Amino acids represented as "Ba" are beta-alanine. The lower-case character "e" or "z" within the designation of a crosslinked amino acid (e.g. "$er8" or "$zr8") represents the configuration of the double bond (E or Z, respectively). In other contexts, lower-case letters such as "a" or "f" represent D amino acids (e.g. D-alanine, or D-phenylalanine, respectively). Amino acids designated as "NmW" represent N-methyltryptophan Amino acids designated as "NmY" represent N-methyltyrosine. Amino acids designated as "NmA" represent N-methylalanine. "Kbio" represents a biotin group attached to the side chain amino group of a lysine residue Amino acids designated as "Sar" represent sarcosine. Amino acids designated as "Cha" represent cyclohexyl alanine. Amino acids designated as "Cpg" represent cyclopentyl glycine Amino acids designated as "Chg" represent cyclohexyl glycine. Amino acids designated as "Cba" represent cyclobutyl alanine Amino acids designated as "F4I" represent 4-iodo phenylalanine. "7L" represents N15 isotopic leucine Amino acids designated as "F3Cl" represent 3-chloro phenylalanine Amino acids designated as "F4cooh" represent 4-carboxy phenylalanine. Amino acids designated as "F34F2" represent 3,4-difluoro phenylalanine Amino acids designated as "6clW" represent 6-chloro tryptophan Amino acids designated as "$rda6" represent alpha-Me R6-hexynyl-alanine alkynyl amino acids, crosslinked via a dialkyne bond to a second alkynyl amino acid Amino acids designated as "$da5" represent alpha-Me S5-pentynyl-alanine alkynyl amino acids, wherein the alkyne forms one half of a dialkyne bond with a second alkynyl amino acid Amino acids designated as "$ra9" represent alpha-Me R9-nonynyl-alanine alkynyl amino acids, crosslinked via an alkyne metathesis reaction with a second alkynyl amino acid Amino acids designated as "$a6" represent alpha-Me S6-hexynyl-alanine alkynyl amino acids, crosslinked via an alkyne metathesis reaction with a second alkynyl amino acid. The designation "iso1" or "iso2" indicates that the peptidomimetic macrocycle is a single isomer.

Amino acids designated as "Cit" represent citrulline Amino acids designated as "Cou4", "Cou6", "Cou7" and "Cou8", respectively, represent the following structures:

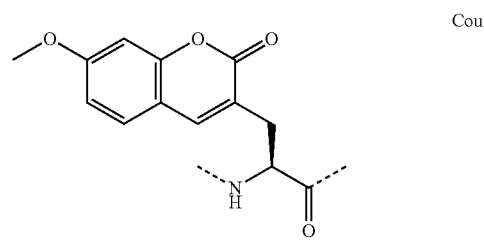

Cou

-continued

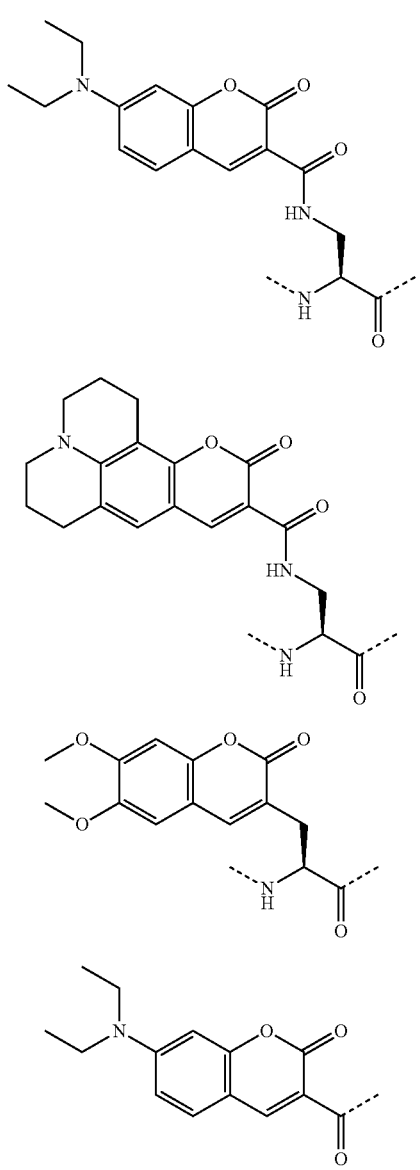

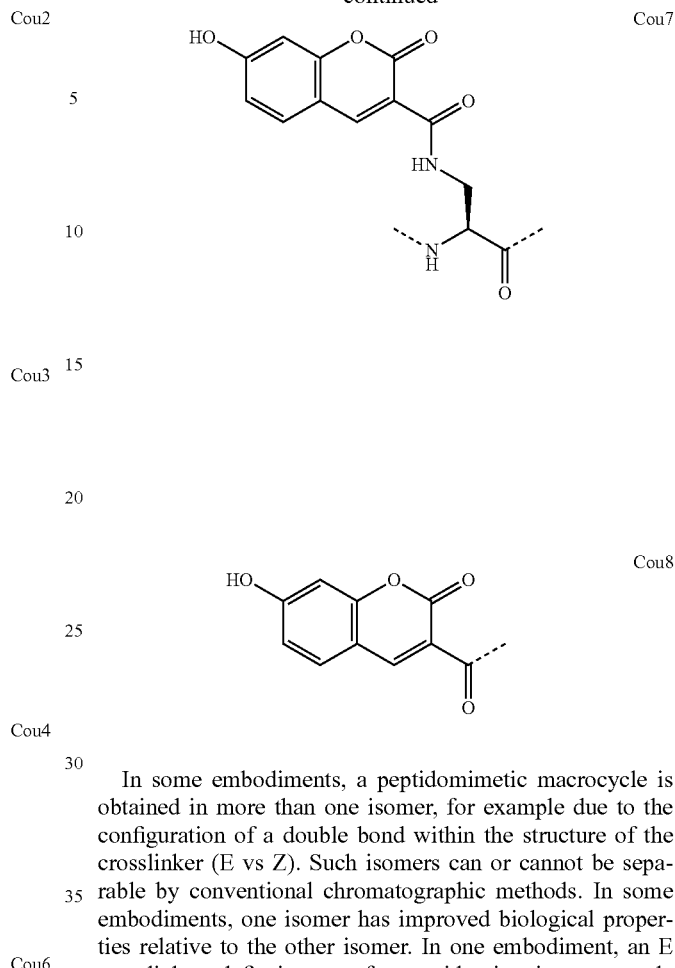

In some embodiments, a peptidomimetic macrocycle is obtained in more than one isomer, for example due to the configuration of a double bond within the structure of the crosslinker (E vs Z). Such isomers can or cannot be separable by conventional chromatographic methods. In some embodiments, one isomer has improved biological properties relative to the other isomer. In one embodiment, an E crosslinker olefin isomer of a peptidomimetic macrocycle has better solubility, better target affinity, better in vivo or in vitro efficacy, higher helicity, or improved cell permeability relative to its Z counterpart. In another embodiment, a Z crosslinker olefin isomer of a peptidomimetic macrocycle has better solubility, better target affinity, better in vivo or in vitro efficacy, higher helicity, or improved cell permeability relative to its E counterpart.

Table 1c shows exemplary peptidomimetic macrocycle:

TABLE 1c
| | Structure |
|---|---|
| SP154 (SEQ ID NO: 163) | 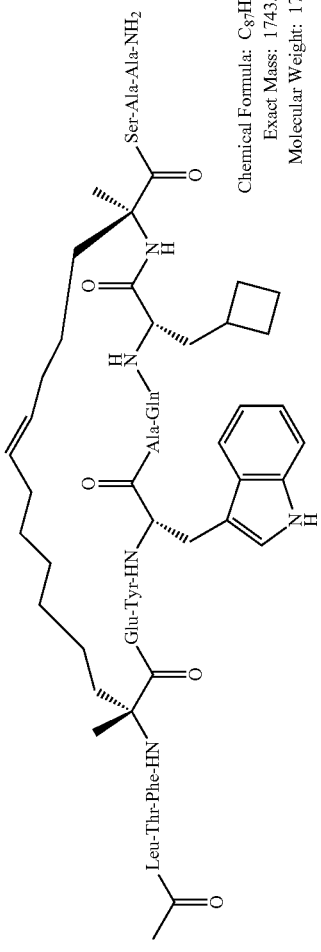 Ac-L T F $er8 EYWAQCba $e SAA -NH2 |
| SP115 (SEQ ID NO: 124) | 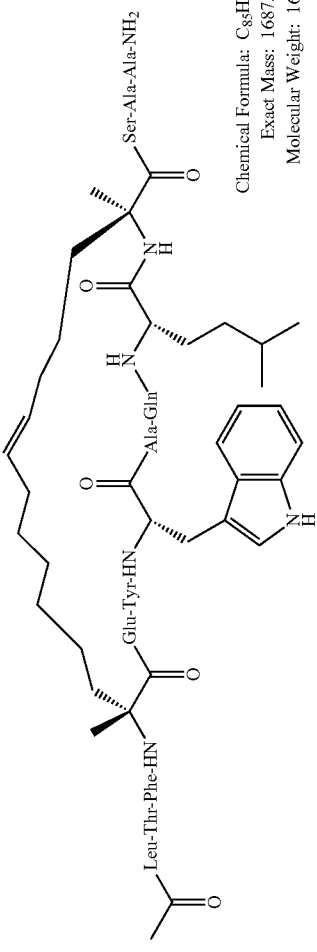 Ac-L T F $er8 AYWAQhL $e SAA -NH2 |

TABLE 1c-continued
| | Structure |
|---|---|
| SP114 (SEQ ID NO: 123) | 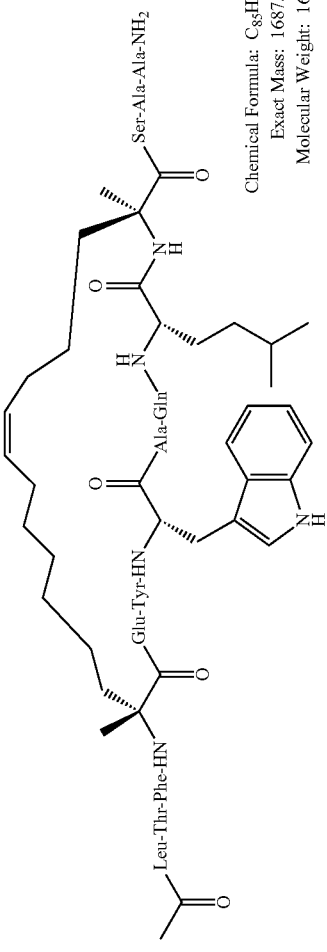  Ac-L T F $zr8 AYWAQhL $z SAA -NH2<br>Chemical Formula: $C_{85}H_{125}N_{17}O_{19}$<br>Exact Mass: 1687.93<br>Molecular Weight: 1689.00 |
| SP99 (SEQ ID NO: 108) | 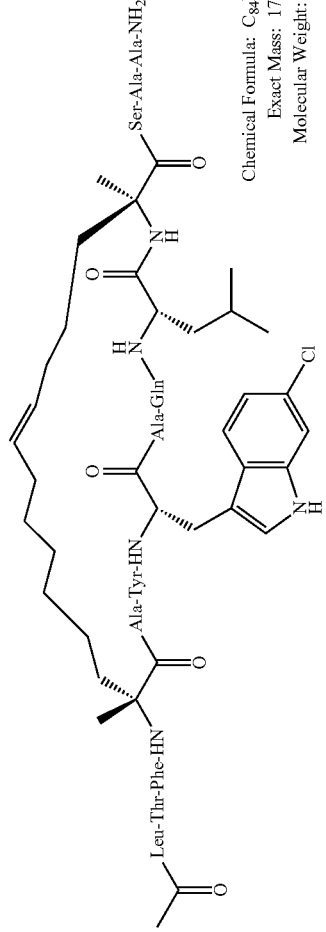  Ac-L T F $er8 AY6clWAQL $e SAA -NH2<br>Chemical Formula: $C_{84}H_{122}ClN_{17}O_{19}$<br>Exact Mass: 1707.88<br>Molecular Weight: 1709.42 |

TABLE 1c-continued
| | Structure |
|---|---|
| SP388 (SEQ ID NO: 397) | 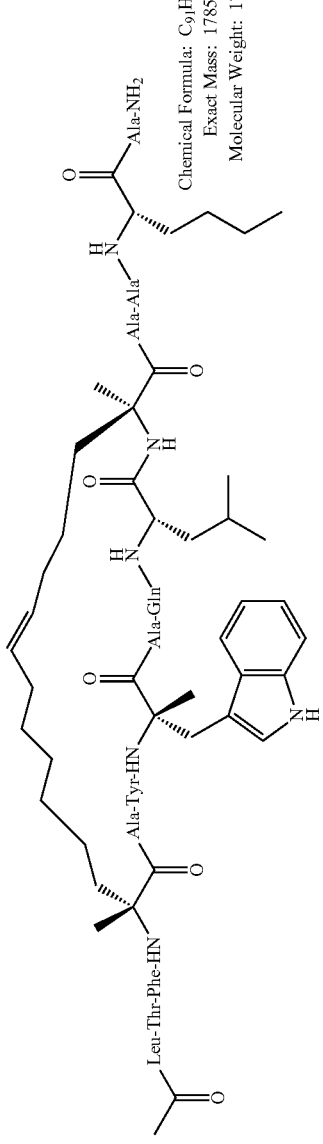<br>Ac-L T F Ser8 AYAmw AQL $e AA Nle A-NH2 |
| SP331 (SEQ ID NO: 340) | 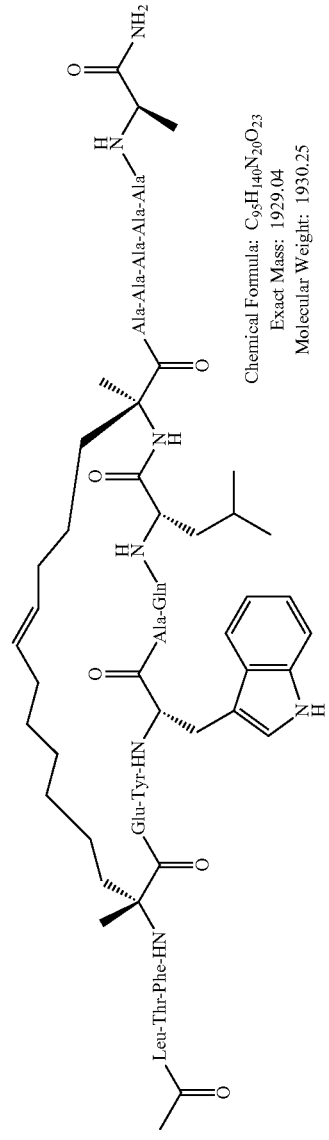<br>Ac-L T F Ser8 EYWAQL $e AAAAAa-NH2 |

TABLE 1c-continued
| | Structure |
|---|---|
| SP445 (SEQ ID NO: 454) | 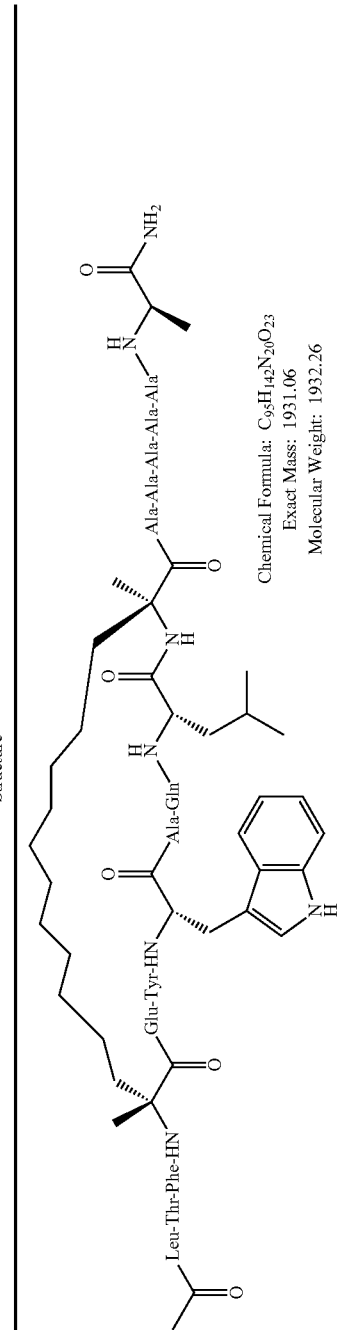Chemical Formula: $C_{95}H_{142}N_{20}O_{23}$<br>Exact Mass: 1931.06<br>Molecular Weight: 1932.26<br><br>Ac-L T F %a8 EYWAQL % AAAAAa-NH2 |
| SP351 (SEQ ID NO: 360) | 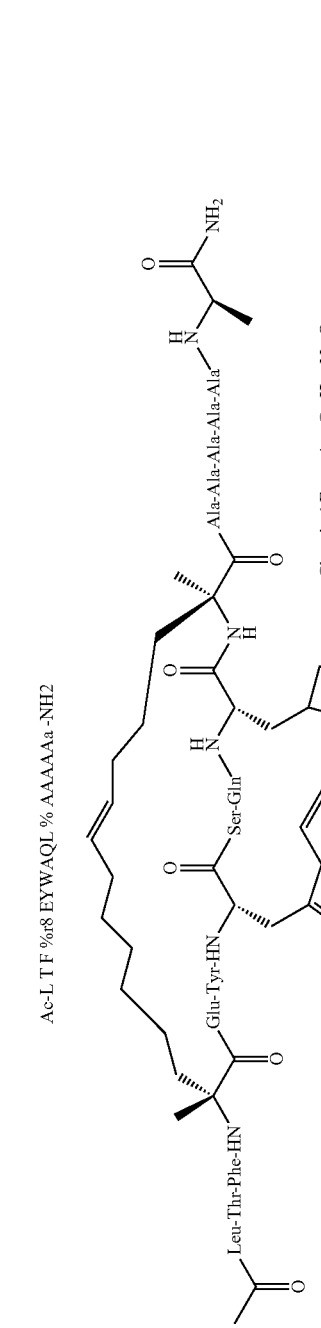Chemical Formula: $C_{96}H_{140}N_{20}O_{24}$<br>Exact Mass: 1957.03<br>Molecular Weight: 1958.26<br><br>Ac-L T F $er8 EYWSQCba $e AAAAAa-NH2 |

TABLE 1c-continued

| | Structure |
|---|---|
| SP71 (SEQ ID NO: 80) | Chemical Formula: C₉₀H₁₃₄N₁₈O₁₉<br>Exact Mass: 1771.01<br>Molecular Weight: 1772.14<br><br>Ac-L T F $er8 AYWAQL $e AA I A-NH2 |
| SP69 (SEQ ID NO: 78) | Chemical Formula: C₉₀H₁₃₄N₁₈O₁₉<br>Exact Mass: 1771.01<br>Molecular Weight: 1772.14<br><br>Ac-L T F $er8 AYWAQL $e AA Nle A-NH2 |

TABLE 1c-continued

| SP7 (SEQ ID NO: 16) | Structure: [Structure of Ac-L T F Sr8 AYWAQLSSA F -NH2] Chemical Formula: C₉₀H₁₂₇N₁₇O₁₉; Exact Mass: 1749.95; Molecular Weight: 1751.07 |
| --- | --- |
| SP160 (SEQ ID NO: 169) | Structure: [Structure of Ac-L T F34F2 Ser8 EYWAQhL $e SAA -NH2] Chemical Formula: C₈₇H₁₂₆F₂N₁₇O₂₁; Exact Mass: 1781.92; Molecular Weight: 1783.02 |

TABLE 1c-continued

Structure

SP315
(SEQ
ID
NO:
324)

Chemical Formula: $C_{93}H_{138}N_{20}O_{21}$
Exact Mass: 1871.03
Molecular Weight: 1872.21

AC-L T F Ser8 AYWAQL SeAAAAAa-NH2

SP249
(SEQ
ID
NO:
258)

Chemical Formula: $C_{94}H_{136}N_{18}O_{22}$
Exact Mass: 1869.01
Molecular Weight: 1870.19

Ac-L T F Ser8 E F4cooh WAQcba Se AA-I-a-NH2

TABLE 1c-continued
| | Structure |
|---|---|
| SP437 (SEQ ID NO: 446) | 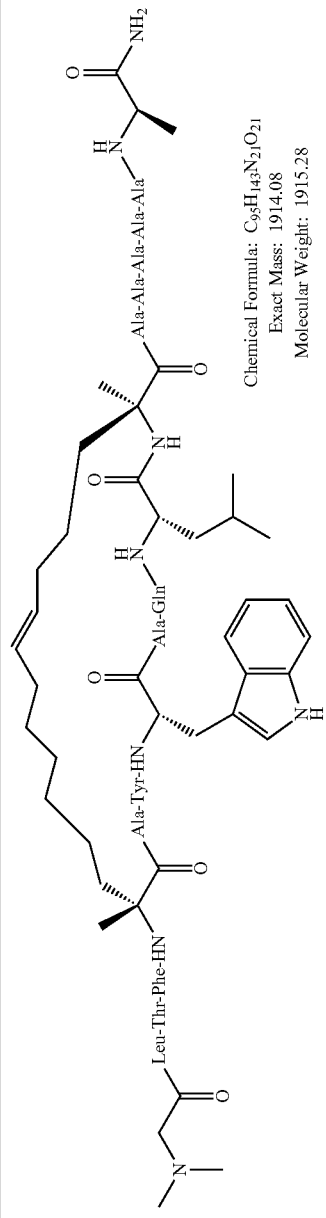<br>Dmaac- L T F $er8 A YWAQL$eAAAAAa -NH2<br>Chemical Formula: $C_{95}H_{143}N_{21}O_{21}$<br>Exact Mass: 1914.08<br>Molecular Weight: 1915.28 |
| SP349 (SEQ ID NO: 358) | 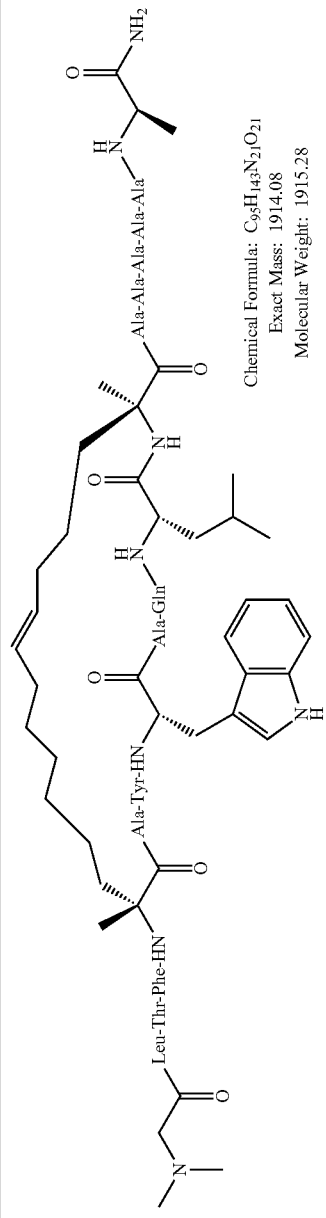<br>Ac-L T F $er8 E F4cooh WAQcba $e AAAAAa-NH2<br>Chemical Formula: $C_{97}H_{140}N_{20}O_{24}$<br>Exact Mass: 1969.03<br>Molecular Weight: 1970.27 |

TABLE 1c-continued
| | Structure |
|---|---|
| SP555 (SEQ ID NO: 464) | 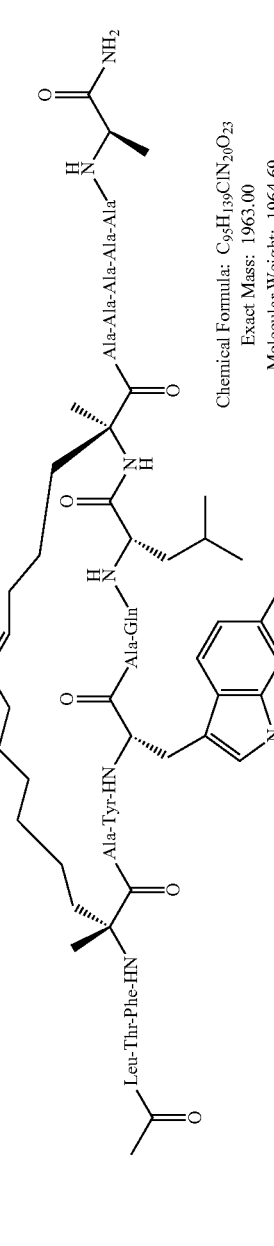  Chemical Formula: C₉₅H₁₃₉ClN₂₀O₂₃  Exact Mass: 1963.00  Molecular Weight: 1964.69  AC-L T F Ser8 E Y6clW A QL Se AAAAAa-NH2 |
| SP557 (SEQ ID NO: 466) | 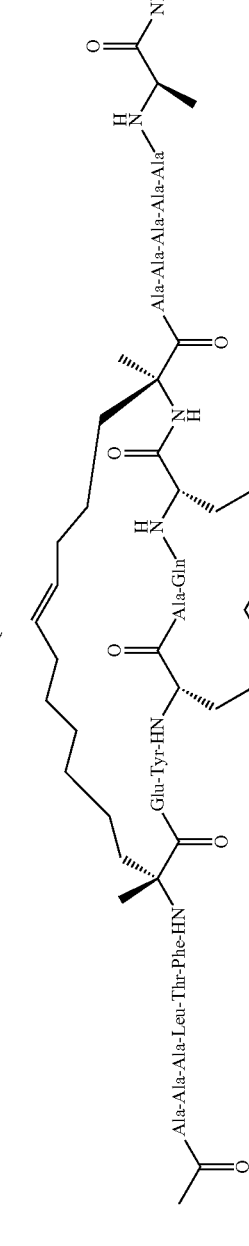  Chemical Formula: C₁₀₄H₁₅₅N₂₃O₂₆  Exact Mass: 2142.15  Molecular Weight: 2143.48  Ac-AAAA L T F Ser8 EYWAWL Se AAAAA a-NH2 |

TABLE 1c-continued
| | Structure |
|---|---|
| SP558 (SEQ ID NO: 467) | 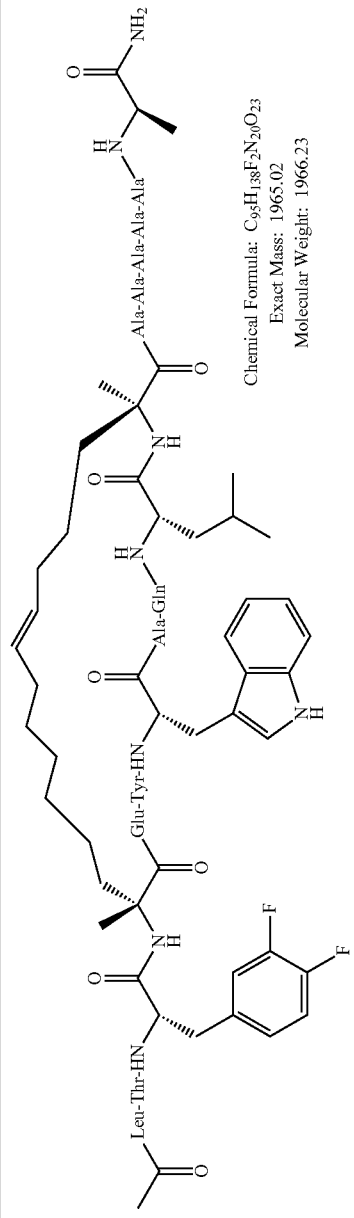 |
| SP367 (SEQ ID NO: 376) | 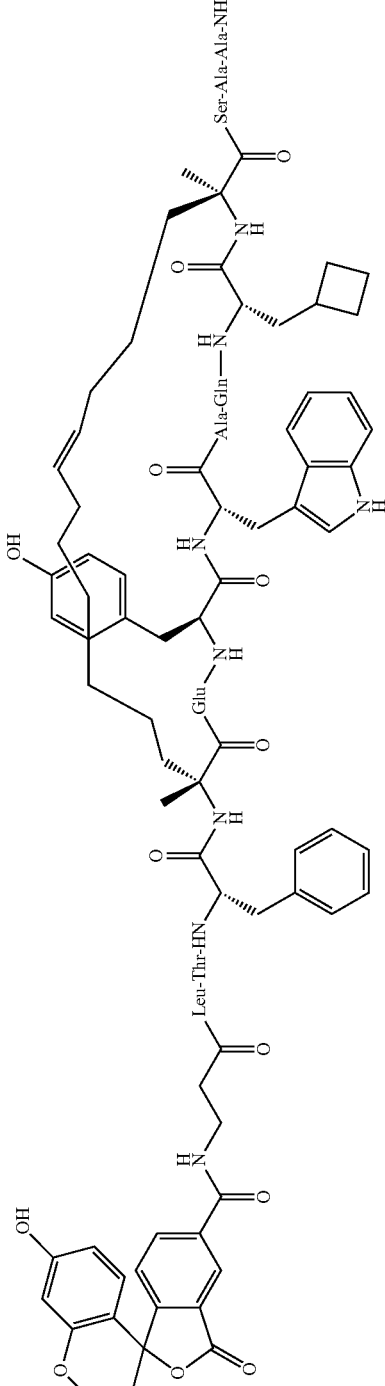 |
| | 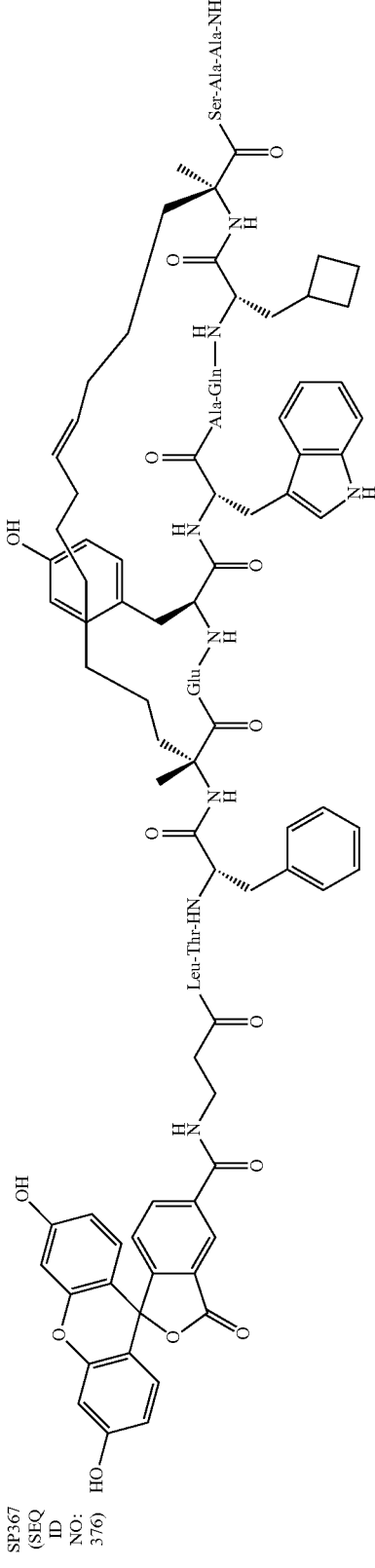 5-FAM- Ba L T F $er8EYWAQCba $e SAA -NH2 |

TABLE 1c-continued
| | Structure |
|---|---|
| SP562 (SEQ ID NO: 471) | 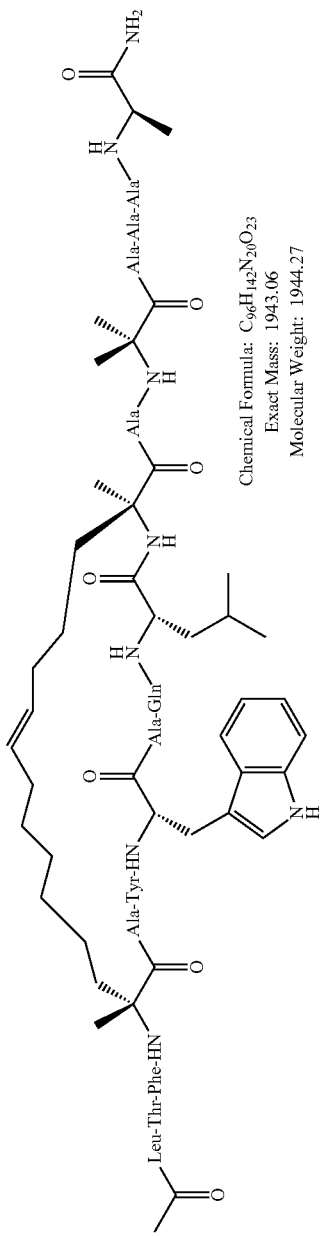 Chemical Formula: C₉₆H₁₄₂N₂₀O₂₃<br>Exact Mass: 1943.06<br>Molecular Weight: 1944.27<br><br>Ac-L T F $Ser8 E YWAQL $e AAib AAAa-NH2 |
| SP564 (SEQ ID NO: 473) | 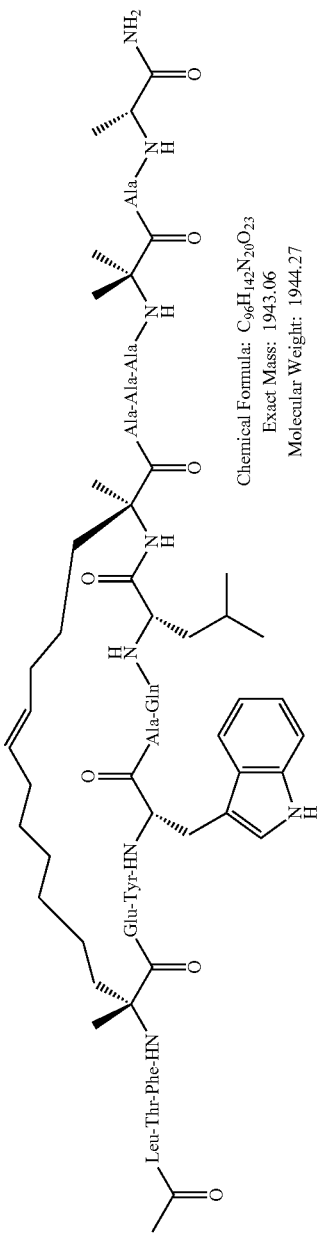 Chemical Formula: C₉₆H₁₄₂N₂₀O₂₃<br>Exact Mass: 1943.06<br>Molecular Weight: 1944.27<br><br>Ac-L T F $Ser8 E YWAQL $e AAA Aib A a-NH2 |

TABLE 1c-continued

| | Structure |
|---|---|
| SP566 (SEQ ID NO: 475) | [structure] |
| SP567 (SEQ ID NO: 476) | [structure] Chemical Formula: $C_{96}H_{142}N_{20}O_{23}$ Exact Mass: 1943.06 Molecular Weight: 1944.27  Ac-L T F Ser8 E YWAQL $e AAAAA Aib -NH2 |

TABLE 1c-continued

| | Structure |
|---|---|
| SP572 (SEQ ID NO: 481) | Chemical Formula: C₉₅H₁₄₀N₂₀O₂₃<br>Exact Mass: 1929.04<br>Molecular Weight: 1930.25<br>Ac-L T F Ser8 EYWAQL $e AAAAA a a -NH2 |
| SP573 (SEQ ID NO: 482) | Chemical Formula: C₉₅H₁₄₀N₂₀O₂₃<br>Exact Mass: 1929.04<br>Molecular Weight: 1930.25<br>Ac-L T F Ser8 EYWAQL $e AAAAAA -NH2 |

TABLE 1c-continued
| | Structure |
|---|---|
| SP578 (SEQ ID NO: 487) | 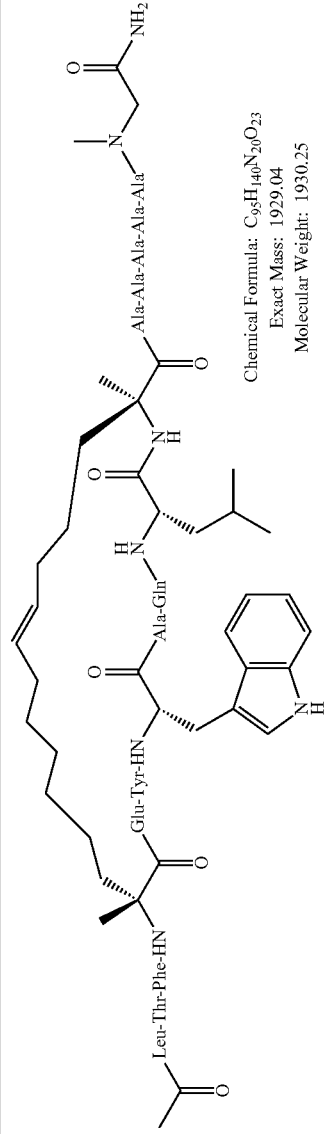  Chemical Formula: C$_{95}$H$_{140}$N$_{20}$O$_{23}$  Exact Mass: 1929.04  Molecular Weight: 1930.25 |
| SP664 (SEQ ID NO: 572) | Ac-L T F $ er8 E YWAQL $e AAAAA Sar-NH2  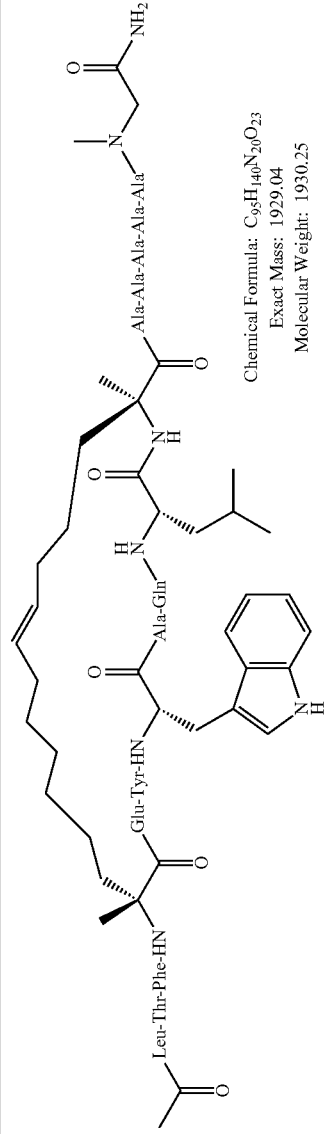  Chemical Formula: C$_{95}$H$_{134}$N$_{20}$O$_{23}$  Exact Mass: 1922.99  Molecular Weight: 1924.20  Ac-LTF$rda6EYWAQL$da5AAAAAa-NH2 |

TABLE 1c-continued
| | Structure |
|---|---|
| SP664 (SEQ ID NO: 572) | 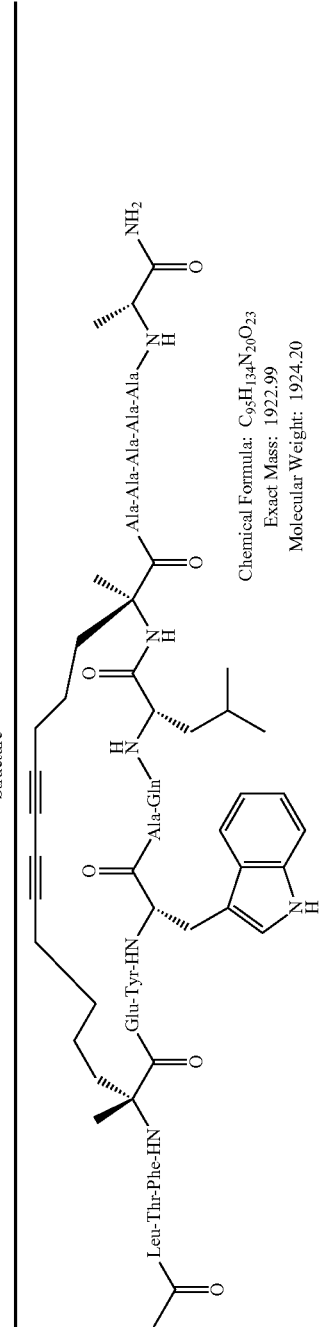 |
| (SEQ ID NO: 1500) | Ac-L T F $rda6 E YWAQL $da5AAAAA a-NH2<br>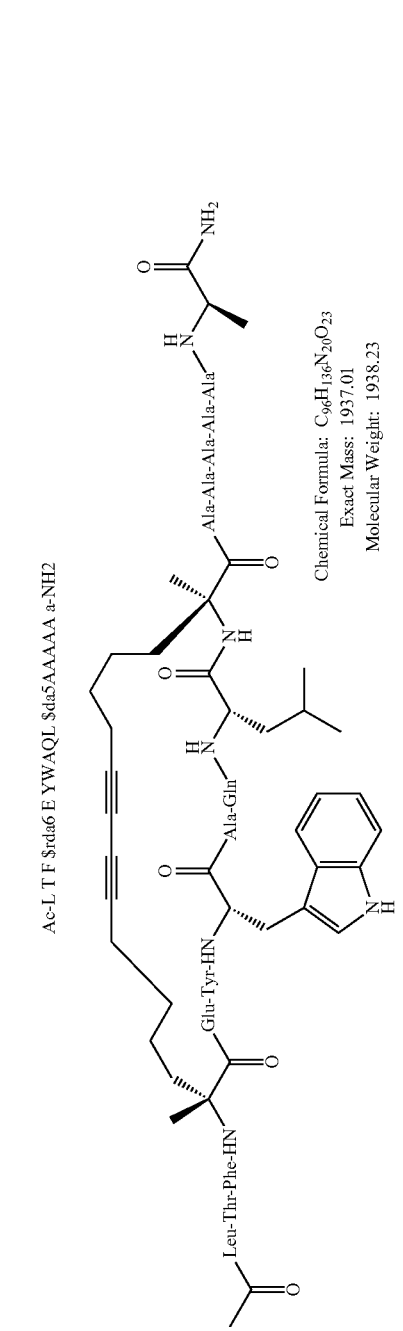 |

In some embodiments, peptidomimetic macrocycles exclude peptidomimetic macrocycles shown in Table 2a:

TABLE 2a

| Number | Sequence | SEQ ID NO: |
|---|---|---|
| 1 | L$r5QETFSD$s8WKLLPEN | 693 |
| 2 | LSQ$r5TFSDLW$s8LLPEN | 694 |
| 3 | LSQE$r5FSDLWK$s8LPEN | 695 |
| 4 | LSQET$r5SDLWKL$s8PEN | 696 |
| 5 | LSQETF$r5DLWKLL$s8EN | 697 |
| 6 | LXQETFS$r5LWKLLP$s8N | 698 |
| 7 | LSQETFSD$r5WKLLPE$s8 | 699 |
| 8 | LSQQTF$r5DLWKLL$s8EN | 700 |
| 9 | LSQETF$r5DLWKLL$s8QN | 701 |
| 10 | LSQQTF$r5DLWKLL$s8QN | 702 |
| 11 | LSQETF$r5NLWKLL$s8QN | 703 |
| 12 | LSQQTF$r5NLWKLL$s8QN | 704 |
| 13 | LSQQTF$r5NLWRLL$s8QN | 705 |
| 14 | QSSSTF$r5NLWKLL$s8QN | 706 |
| 15 | QSQQTF$r5NLWKLL$s8QN | 707 |
| 16 | QSQQTA$r5NLWRLL$s8QN | 708 |
| 17 | L$r8QETFSD$WKLLPEN | 709 |
| 18 | LSQ$r8TFSDLW$LLPEN | 710 |
| 19 | LSQE$r8FSDLWK$LPEN | 711 |
| 20 | LSQET$r8SDLWKL$PEN | 712 |
| 21 | LSQETF$r8DLWKLL$EN | 713 |
| 22 | LXQETFS$r8LWKLLP$N | 714 |
| 23 | LSQETFSD$r8WKLLPE$ | 715 |
| 24 | LSQQTF$r8DLWKLL$EN | 716 |
| 25 | LSQETF$r8DLWKLL$QN | 717 |
| 26 | LSQQTF$r8DLWKLL$QN | 718 |
| 27 | LSQETF$r8NLWKLL$QN | 719 |
| 28 | LSQQTF$r8NLWKLL$QN | 720 |
| 29 | LSQQTF$r8NLWRLL$QN | 721 |
| 30 | QSQQTF$r8NLWKLL$QN | 722 |
| 31 | QSQQTF$r8NLWRLL$QN | 723 |
| 32 | QSQQTA$r8NLWRLL$QN | 724 |
| 33 | QSQQTF$r8NLWRKK$QN | 725 |
| 34 | QQTF$r8DLWRLL$EN | 726 |
| 35 | QQTF$r8DLWRLL$ | 727 |
| 36 | LSQQTF$DLW$LL | 728 |
| 37 | QQTF$DLW$LL | 729 |
| 38 | QQTA$r8DLWRLL$EN | 730 |
| 39 | QSQQTF$r5NLWRLL$s8QN (dihydroxylated olefin) | 731 |
| 40 | QSQQTA$r5NLWRLL$s8QN (dihydroxylated olefin) | 732 |
| 41 | QSQQTF$r8DLWRLL$QN | 733 |
| 42 | QTF$r8NLWRLL$ | 734 |
| 43 | QSQQTF$NLW$LLPQN | 735 |
| 44 | QS$QTF$NLWRLLPQN | 736 |
| 45 | $TFS$LWKLL | 737 |
| 46 | ETF$DLW$LL | 738 |
| 47 | QTF$NLW$LL | 739 |
| 48 | $SQE$FSNLWKLL | 740 |

In Table 2a, X represents S or any amino acid. Peptides shown can comprise an N-terminal capping group such as acetyl or an additional linker such as beta-alanine between the capping group and the start of the peptide sequence.

In some embodiments, peptidomimetic macrocycles do not comprise a peptidomimetic macrocycle structure as shown in Table 2a.

In other embodiments, peptidomimetic macrocycles exclude peptidomimetic macrocycles shown in Table 2b:

TABLE 2B

| Number | Sequence | SEQ ID NO: | Exact Mass | M + 2 | Observed mass (m/e) |
|---|---|---|---|---|---|
| 1 | Ac-LSQETF$r8DLWKLL$EN-NH2 | 741 | 2068.13 | 1035.07 | 1035.36 |
| 2 | Ac-LSQETF$r8NLWKLL$QN-NH2 | 742 | 2066.16 | 1034.08 | 1034.31 |
| 3 | Ac-LSQQTF$r8NLWRLL$QN-NH2 | 743 | 2093.18 | 1047.59 | 1047.73 |
| 4 | Ac-QSQQTF$r8NLWKLL$QN-NH2 | 744 | 2080.15 | 1041.08 | 1041.31 |
| 5 | Ac-QSQQTF$r8NLWRLL$QN-NH2 | 745 | 2108.15 | 1055.08 | 1055.32 |
| 6 | Ac-QSQQTA$r8NLWRLL$QN-NH2 | 746 | 2032.12 | 1017.06 | 1017.24 |

TABLE 2B-continued

| Number | Sequence | SEQ ID NO: | Exact Mass | M + 2 | Observed mass (m/e) |
|---|---|---|---|---|---|
| 7 | Ac-QAibQQTF$r8NLWRLL$QN-NH2 | 747 | 2106.17 | 1054.09 | 1054.34 |
| 8 | Ac-QSQQTFSNLWRLLPQN-NH2 | 748 | 2000.02 | 1001.01 | 1001.26 |
| 9 | Ac-QSQQTF$/r8NLWRLL$/QN-NH2 | 749 | 2136.18 | 1069.09 | 1069.37 |
| 10 | Ac-QSQAibTF$r8NLWRLL$QN-NH2 | 750 | 2065.15 | 1033.58 | 1033.71 |
| 11 | Ac-QSQQTF$r8NLWRLL$AN-NH2 | 751 | 2051.13 | 1026.57 | 1026.70 |
| 12 | Ac-ASQQTF$r8NLWRLL$QN-NH2 | 752 | 2051.13 | 1026.57 | 1026.90 |
| 13 | Ac-QSQQTF$r8ALWRLL$QN-NH2 | 753 | 2065.15 | 1033.58 | 1033.41 |
| 14 | Ac-QSQETF$r8NLWRLL$QN-NH2 | 754 | 2109.14 | 1055.57 | 1055.70 |
| 15 | Ac-RSQQTF$r8NLWRLL$QN-NH2 | 755 | 2136.20 | 1069.10 | 1069.17 |
| 16 | Ac-RSQQTF$r8NLWRLL$EN-NH2 | 756 | 2137.18 | 1069.59 | 1069.75 |
| 17 | Ac-LSQETFSDLWKLLPEN-NH2 | 757 | 1959.99 | 981.00 | 981.24 |
| 18 | Ac-QSQ$TFS$LWRLLPQN-NH2 | 758 | 2008.09 | 1005.05 | 1004.97 |
| 19 | Ac-QSQQ$FSN$WRLLPQN-NH2 | 759 | 2036.06 | 1019.03 | 1018.86 |
| 20 | Ac-QSQQT$SNL$RLLPQN-NH2 | 760 | 1917.04 | 959.52 | 959.32 |
| 21 | Ac-QSQQTF$NLW$LLPQN-NH2 | 761 | 2007.06 | 1004.53 | 1004.97 |
| 22 | Ac-RTQATF$r8NQWAiBANle$TNAibTR-NH2 | 762 | 2310.26 | 1156.13 | 1156.52 |
| 23 | Ac-QSQQTF$r8NLWRLL$RN-NH2 | 763 | 2136.20 | 1069.10 | 1068.94 |
| 24 | Ac-QSQRTF$r8NLWRLL$QN-NH2 | 764 | 2136.20 | 1069.10 | 1068.94 |
| 25 | Ac-QSQQTF$r8NNleWRLL$QN-NH2 | 765 | 2108.15 | 1055.08 | 1055.44 |
| 26 | Ac-QSQQTF$r8NLWRNleL$QN-NH2 | 766 | 2108.15 | 1055.08 | 1055.84 |
| 27 | Ac-QSQQTF$r8NLWRLNle$QN-NH2 | 767 | 2108.15 | 1055.08 | 1055.12 |
| 28 | Ac-QSQQTY$r8NLWRLL$QN-NH2 | 768 | 2124.15 | 1063.08 | 1062.92 |
| 29 | Ac-RAibQQTF$r8NLWRLL$QN-NH2 | 769 | 2134.22 | 1068.11 | 1068.65 |
| 30 | Ac-MPRFMDYWEGLN-NH2 | 770 | 1598.70 | 800.35 | 800.45 |
| 31 | Ac-RSQQRF$r8NLWRLL$QN-NH2 | 771 | 2129.25 | 1096.63 | 1096.83 |
| 32 | Ac-QSQQRF$r8NLWRLL$QN-NH2 | 772 | 2163.21 | 1082.61 | 1082.87 |
| 33 | Ac-RAibQQRF$r8NLWRLL$QN-NH2 | 773 | 2189.27 | 1095.64 | 1096.37 |
| 34 | Ac-RSQQRF$r8NFWRLL$QN-NH2 | 774 | 2225.23 | 1113.62 | 1114.37 |
| 35 | Ac-RSQQRF$r8NYWRLL$QN-NH2 | 775 | 2241.23 | 1121.62 | 1122.37 |
| 36 | Ac-RSQQTF$r8NLWQLL$QN-NH2 | 776 | 2108.15 | 1055.08 | 1055.29 |
| 37 | Ac-QSQQTF$r8NLWQAmlL$QN-NH2 | 777 | 2094.13 | 1048.07 | 1048.32 |
| 38 | Ac-QSQQTF$r8NAmlWRLL$QN-NH2 | 778 | 2122.17 | 1062.09 | 1062.35 |
| 39 | Ac-NlePRF$r8DYWEGL$QN-NH2 | 779 | 1869.98 | 935.99 | 936.20 |
| 40 | Ac-NlePRF$r8NYWRLL$QN-NH2 | 780 | 1952.12 | 977.06 | 977.35 |
| 41 | Ac-RF$r8NLWRLL$Q-NH2 | 781 | 1577.96 | 789.98 | 790.18 |
| 42 | Ac-QSQQTF$r8N2ffWRLL$QN-NH2 | 782 | 2160.13 | 1081.07 | 1081.40 |
| 43 | Ac-QSQQTF$r8N3ffWRLL$QN-NH2 | 783 | 2160.13 | 1081.07 | 1081.34 |
| 44 | Ac-QSQQTF#r8NLWRLL#QN-NH2 | 784 | 2080.12 | 1041.06 | 1041.34 |

TABLE 2B-continued

| Number | Sequence | SEQ ID NO: | Exact Mass | M + 2 | Observed mass (m/e) |
|---|---|---|---|---|---|
| 45 | Ac-RSQQTA$r8NLWRLL$QN-NH2 | 785 | 2060.16 | 1031.08 | 1031.38 |
| 46 | Ac-QSQQTF%r8NLWRLL%QN-NH2 | 786 | 2110.17 | 1056.09 | 1056.55 |
| 47 | HepQSQ$TFSNLWRLLPQN-NH2 | 787 | 2051.10 | 1026.55 | 1026.82 |
| 48 | HepQSQ$TF$r8NLWRLL$QN-NH2 | 788 | 2159.23 | 1080.62 | 1080.89 |
| 49 | Ac-QSQQTF$r8NL6clWRLL$QN-NH2 | 789 | 2142.11 | 1072.06 | 1072.35 |
| 50 | Ac-QSQQTF$r8NLMe6clWRLL$QN-NH2 | 790 | 2156.13 | 1079.07 | 1079.27 |
| 51 | Ac-LTFEHYWAQLTS-NH2 | 791 | 1535.74 | 768.87 | 768.91 |
| 52 | Ac-LTF$HYW$QLTS-NH2 | 792 | 1585.83 | 793.92 | 794.17 |
| 53 | Ac-LTFE$YWA$LTS-NH2 | 793 | 1520.79 | 761.40 | 761.67 |
| 54 | Ac-LTF$zr8HYWAQL$zS-NH2 | 794 | 1597.87 | 799.94 | 800.06 |
| 55 | Ac-LTF$r8HYWRQL$S-NH2 | 795 | 1682.93 | 842.47 | 842.72 |
| 56 | Ac-QS$QTFStNLWRLL$s8QN-NH2 | 796 | 2145.21 | 1073.61 | 1073.90 |
| 57 | Ac-QSQQTASNLWRLLPQN-NH2 | 797 | 1923.99 | 963.00 | 963.26 |
| 58 | Ac-QSQQTA$/r8NLWRLL$/QN-NH2 | 798 | 2060.15 | 1031.08 | 1031.24 |
| 59 | Ac-ASQQTF$/r8NLWRLL$/QN-NH2 | 799 | 2079.16 | 1040.58 | 1040.89 |
| 60 | Ac-$SQQ$FSNLWRLLAibQN-NH2 | 800 | 2009.09 | 1005.55 | 1005.86 |
| 61 | Ac-QS$QTF$NLWRLLAibQN-NH2 | 801 | 2023.10 | 1012.55 | 1012.79 |
| 62 | Ac-QSQQ$FSN$WRLLAibQN-NH2 | 802 | 2024.06 | 1013.03 | 1013.31 |
| 63 | Ac-QSQQTF$NLW$LLAibQN-NH2 | 803 | 1995.06 | 998.53 | 998.87 |
| 64 | Ac-QSQQTFS$LWR$LAibQN-NH2 | 804 | 2011.06 | 1006.53 | 1006.83 |
| 65 | Ac-QSQQTFSNLW$LLA$N-NH2 | 805 | 1940.02 | 971.01 | 971.29 |
| 66 | Ac-$/SQQ$/FSNLWRLLAibQN-NH2 | 806 | 2037.12 | 1019.56 | 1019.78 |
| 67 | Ac-QS$/WTF$/NLWRLLAibQN-NH2 | 807 | 2051.13 | 1026.57 | 1026.90 |
| 68 | Ac-QSQQ$/FSN$/WRLLAibQN-NH2 | 808 | 2052.09 | 1027.05 | 1027.36 |
| 69 | Ac-QSQQTF$/NLW$/LLAibQN-NH2 | 809 | 2023.09 | 1012.55 | 1013.82 |
| 70 | Ac-QSQsTFS$LWRLLAibQN-NH2 | 810 | 1996.09 | 999.05 | 999.39 |
| 71 | Ac-QSQ$/TFS$/LWRLLAibQN-NH2 | 811 | 2024.12 | 1013.06 | 1013.37 |
| 72 | Ac-QS$/STFSt//NLWRLL$/s8QN-NH2 | 812 | 2201.27 | 1101.64 | 1102.00 |
| 73 | Ac-$r8QQTFS$LWRLLAibQN-NH2 | 813 | 2038.14 | 1020.07 | 1020.23 |
| 74 | Ac-QSQ$r8TFSNLW$LLAibQN-NH2 | 814 | 1996.08 | 999.04 | 999.32 |
| 75 | Ac-QSQQTFS$r8LWRLLA$N-NH2 | 815 | 2024.12 | 1013.06 | 1013.37 |
| 76 | Ac-QS$5rQTFStNLW$LLAibQN-NH2 | 816 | 2032.12 | 1017.06 | 1017.39 |
| 77 | Ac-$/r8SQQTFS$/LWRLLAibQN-NH2 | 817 | 2066.17 | 1034.09 | 1034.80 |
| 78 | Ac-QSQ$/r8TFSNLW$/LLAibQN-NH2 | 818 | 2024.11 | 1013.06 | 1014.34 |
| 79 | Ac-QSQQTFS$/r8LWRLLA$/N-NH2 | 819 | 2052.15 | 1027.08 | 1027.16 |
| 80 | Ac-QS$/r5QTFSt//NLW$/LLAibQN-NH2 | 820 | 2088.18 | 1045.09 | 1047.10 |
| 81 | Ac-QSQQTFSNLWRLLAibQN-NH2 | 821 | 1988.02 | 995.01 | 995.31 |
| 82 | Hep/QSQ$/TF$/r8NLWRLL$/QN-NH2 | 822 | 2215.29 | 1108.65 | 1108.93 |

TABLE 2B-continued

| Number | Sequence | SEQ ID NO: | Exact Mass | M + 2 | Observed mass (m/e) |
|---|---|---|---|---|---|
| 83 | Ac-ASAATF$r8NLRWLL$QN-NH2 | 823 | 2051.13 | 1026.57 | 1026.90 |
| 84 | Ac-QSQQTF$/r8NLWRLL$/Q-NH2 | 824 | 2022.14 | 1012.07 | 1012.66 |
| 85 | Ac-QSQQTF$r8NLWRLL$Q-NH2 | 825 | 1994.11 | 998.06 | 998.42 |
| 86 | Ac-AAARAA$r8AAARAA$AA-NH2 | 826 | 1515.90 | 758.95 | 759.21 |
| 87 | Ac-LTFEHYWAQLTSA-NH2 | 827 | 1606.78 | 804.39 | 804.59 |
| 88 | Ac-LTF$r8HYWAQL$SA-NH2 | 828 | 1668.90 | 735.45 | 835.67 |
| 89 | Ac-ASQQTFSNLWRLLPQN-NH2 | 829 | 1943.00 | 972.50 | 973.27 |
| 90 | Ac-QS$QTFStNLW$r5LLAibQN-NH2 | 830 | 2032.12 | 1017.06 | 1017.30 |
| 91 | Ac-QSQQTFAibNLWRLLAibQN-NH2 | 831 | 1986.04 | 994.02 | 994.19 |
| 92 | Ac-QSQQTFNleNLWRLLNleQN-NH2 | 832 | 2042.11 | 1022.06 | 1022.23 |
| 93 | Ac-QSQQTF$/r8NLWRLLAibQN-NH2 | 833 | 2082.14 | 1042.07 | 1042.23 |
| 94 | Ac-QSQQTF$/r8NLWRLLNleQN-NH2 | 834 | 2110.17 | 1056.09 | 1056.29 |
| 95 | Ac-QSQQTFAibNLWRLL$/QN-NH2 | 835 | 2040.09 | 1021.05 | 1021.25 |
| 96 | Ac-QSQQTFNleNLWRLL$/QN-NH2 | 836 | 2068.12 | 1035.06 | 1035.31 |
| 97 | Ac-QSQQTF%r8NL6clWRNleL%QN-NH2 | 837 | 2144.13 | 1073.07 | 1073.32 |
| 98 | Ac-QSQQTF%r8NLMe6clWRLL%QN-NH2 | 838 | 2158.15 | 1080.08 | 1080.31 |
| 101 | Ac-FNle$YWE$L-NH2 | 839 | 1160.63 | — | 1161.70 |
| 102 | Ac-F$r8AYWELL$A-NH2 | 840 | 1344.75 | — | 1345.90 |
| 103 | Ac-F$r8AYWQLL$A-NH2 | 841 | 1343.76 | — | 1344.83 |
| 104 | Ac-NlePRF$r8NYWELL$QN-NH2 | 842 | 1925.06 | 963.53 | 963.69 |
| 105 | Ac-NlePRF$r8DYWRLL$QN-NH2 | 843 | 1953.10 | 977.55 | 977.68 |
| 106 | Ac-NlePRF$r8NYWRLL$Q-NH2 | 844 | 1838.07 | 920.04 | 920.18 |
| 107 | Ac-NlePRF$r8NYWRLL$-NH2 | 845 | 1710.01 | 856.01 | 856.13 |
| 108 | Ac-QSQQTF$r8DLWRLL$QN-NH2 | 846 | 2109.14 | 1055.57 | 1055.64 |
| 109 | Ac-QSQQTF$r8NLWRLL$EN-NH2 | 847 | 2109.14 | 1055.57 | 1055.70 |
| 110 | Ac-QSQQTF$r8NLWRLL$QD-NH2 | 848 | 2109.14 | 1055.57 | 1055.64 |
| 111 | Ac-QSQQTF$r8NLWRLL$S-NH2 | 849 | 1953.08 | 977.54 | 977.60 |
| 112 | Ac-ESQQTF$r8NLWRLL$QN-NH2 | 850 | 2109.14 | 1055.57 | 1055.70 |
| 113 | Ac-LTF$r8NLWRNleL$Q-NH2 | 851 | 1635.99 | 819.00 | 819.10 |
| 114 | Ac-LRF$r8NLWRNleL$Q-NH2 | 852 | 1691.04 | 846.52 | 846.68 |
| 115 | Ac-QSQQTF$r8NWWRNleL$QN-NH2 | 853 | 2181.15 | 1091.58 | 1091.64 |
| 116 | Ac-QSQQTF$r8NLWRNleL$Q-NH2 | 854 | 1994.11 | 998.06 | 998.07 |
| 117 | Ac-QTF$r8NLWRNleL$QN-NH2 | 855 | 1765.00 | 883.50 | 883.59 |
| 118 | Ac-NlePRF$r8NWWRLL$QN-NH2 | 856 | 1975.13 | 988.57 | 988.75 |
| 119 | Ac-NlePRF$r8NWWRLL$A-NH2 | 857 | 1804.07 | 903.04 | 903.08 |
| 120 | Ac-TSFAEYWNLLNH2 | 858 | 1467.70 | 734.85 | 734.90 |
| 121 | Ac-QTF$r8HWWSQL$S-NH2 | 859 | 1651.85 | 826.93 | 827.12 |
| 122 | Ac-FM$YWE$L-NH2 | 860 | 1178.58 | — | 1179.64 |

TABLE 2B-continued

| Number | Sequence | SEQ ID NO: | Exact Mass | M + 2 | Observed mass (m/e) |
|---|---|---|---|---|---|
| 123 | Ac-QTFEHWWSQLLS-NH2 | 861 | 1601.76 | 801.88 | 801.94 |
| 124 | Ac-QSQQTF$r8NLAmwRLNle$QN-NH2 | 862 | 2122.17 | 1062.09 | 1062.24 |
| 125 | Ac-FMAibY6clWEAc3cL-NH2 | 863 | 1130.47 | - | 1131.53 |
| 126 | Ac-FNle$Y6clWE$L-NH2 | 864 | 1194.59 | - | 1195.64 |
| 127 | Ac-F$zr8AY6clWEAc3cL$z-NH2 | 865 | 1277.63 | 639.82 | 1278.71 |
| 128 | Ac-F$r8AY6clWEAc3cL$A-NH2 | 866 | 1348.66 | - | 1350.72 |
| 129 | Ac-NlePRF$r8NY6clWRLL$QN-NH2 | 867 | 1986.08 | 994.04 | 994.64 |
| 130 | Ac-AF$r8AAWALA$A-NH2 | 868 | 1223.71 | - | 1224.71 |
| 131 | Ac-TF$r8AAWRLA$Q-NH2 | 869 | 1395.80 | 698.90 | 399.04 |
| 132 | Pr-TF$r8AAWRLA$Q-NH2 | 870 | 1409.82 | 705.91 | 706.04 |
| 133 | Ac-QSQQTF%r8NLWRNle L%QN-NH2 | 871 | 2110.17 | 1056.09 | 1056.22 |
| 134 | Ac-LTF%r8HYWAQL%SA-NH2 | 872 | 1670.92 | 836.46 | 836.58 |
| 135 | Ac-NlePRF%r8NYWRLL%QN-NH2 | 873 | 1954.13 | 978.07 | 978.19 |
| 136 | Ac-NlePRF%r8NY6clWRLL%QN-NH2 | 874 | 1988.09 | 995.05 | 995.68 |
| 137 | Ac-LTF%r8HY6clWAQL%S-NH2 | 875 | 1633.84 | 817.92 | 817.93 |
| 138 | Ac-QS%QTF%StNLWRLL%s8QN-NH2 | 876 | 2149.24 | 1075.62 | 1075.65 |
| 139 | Ac-LTF%r8HY6clWRQL%S-NH2 | 877 | 1718.91 | 860.46 | 860.54 |
| 140 | Ac-QSQQTF%r8NL6clWRLL%QN-NH2 | 878 | 2144.13 | 1073.07 | 1073.64 |
| 141 | Ac-%r8SQQTFS%LWRLLAibQN-NH2 | 879 | 2040.15 | 1021.08 | 1021.13 |
| 142 | Ac-LTF%r8HYWAQL%S-NH2 | 880 | 1599.88 | 800.94 | 801.09 |
| 143 | Ac-TSF%r8QYWNLL%P-NH2 | 881 | 1602.88 | 802.44 | 802.58 |
| 147 | Ac-LTFEHYWAQLTS-NH2 | 882 | 1535.74 | 768.87 | 769.5 |
| 152 | Ac-F$er8AY6clWEAc3cL$e-NH2 | 883 | 1277.63 | 639.82 | 1278.71 |
| 153 | Ac-AF$r8AAWALA$A-NH2 | 884 | 1277.63 | 639.82 | 1277.84 |
| 154 | Ac-TF$r8AAWRLA$Q-NH2 | 885 | 1395.80 | 698.90 | 699.04 |
| 155 | Pr-TF$r8AAWRLA$Q-NH2 | 886 | 1409.82 | 705.91 | 706.04 |
| 156 | Ac-LTF$er8HYWAQL$eS-NH2 | 887 | 1597.87 | 799.94 | 800.44 |
| 159 | Ac-CCPGCCBaQSQQTF$r8NLWRLL$QN-NH2 | 888 | 2745.30 | 1373.65 | 1372.99 |
| 160 | Ac-CCPGCCBaQSQQTA$r8NLWRLL$QN-NH2 | 889 | 2669.27 | 1335.64 | 1336.09 |
| 161 | Ac-CCPGCCBaNlePRF$r8NYWRLL$QN-NH2 | 890 | 2589.26 | 1295.63 | 1296.2 |
| 162 | Ac-LTF$/r8HYWAQL$/S-NH2 | 891 | 1625.90 | 813.95 | 814.18 |
| 163 | Ac-F%r8HY6clWRAc3cL%-NH2 | 892 | 1372.72 | 687.36 | 687.59 |
| 164 | Ac-QTF%r8HWWSQL%S-NH2 | 893 | 1653.87 | 827.94 | 827.94 |
| 165 | Ac-LTA$r8HYWRQL$S-NH2 | 894 | 1606.90 | 804.45 | 804.66 |
| 166 | Ac-Q$r8QQTFSN$WRLLAibQN-NH2 | 895 | 2080.12 | 1041.06 | 1041.61 |
| 167 | Ac-QSQQ$r8FSNLWR$LAibQN-NH2 | 896 | 2066.11 | 1034.06 | 1034.58 |
| 168 | Ac-F$r8AYWEAc3cL$A-NH2 | 897 | 1314.70 | 658.35 | 1315.88 |
| 169 | Ac-F$r8AYWEAc3cL$S-NH2 | 898 | 1330.70 | 666.35 | 1331.87 |

TABLE 2B-continued

| Number | Sequence | SEQ ID NO: | Exact Mass | M + 2 | Observed mass (m/e) |
|---|---|---|---|---|---|
| 170 | Ac-F$r8AYWEAc3cL$Q-NH2 | 899 | 1371.72 | 686.86 | 1372.72 |
| 171 | Ac-F$r8AYWEAibL$S-NH2 | 900 | 1332.71 | 667.36 | 1334.83 |
| 172 | Ac-F$r8AYWEAL$S-NH2 | 901 | 1318.70 | 660.35 | 1319.73 |
| 173 | Ac-F$r8AYWEQL$S-NH2 | 902 | 1375.72 | 688.86 | 1377.53 |
| 174 | Ac-F$r8HYWEQL$S-NH2 | 903 | 1441.74 | 721.87 | 1443.48 |
| 175 | Ac-F$r8HYWAQL$S-NH2 | 904 | 1383.73 | 692.87 | 1385.38 |
| 176 | Ac-F$r8HYWAAc3cL$S-NH2 | 905 | 1338.71 | 670.36 | 1340.82 |
| 177 | Ac-F$r8HYWRAc3cL$S-NH2 | 906 | 1423.78 | 712.89 | 713.04 |
| 178 | Ac-F$r8AYWEAc3cL#A-NH2 | 907 | 1300.69 | 651.35 | 1302.78 |
| 179 | Ac-NlePTF%r8NYWRLL%QN-NH2 | 908 | 1899.08 | 950.54 | 950.56 |
| 180 | Ac-TF$r8AAWRAL$Q-NH2 | 909 | 1395.80 | 698.90 | 699.13 |
| 181 | Ac-TSF%r8HYWAQL%S-NH2 | 910 | 1573.83 | 787.92 | 787.98 |
| 184 | Ac-F%r8AY6clWEAc3cL%A-NH2 | 911 | 1350.68 | 676.34 | 676.91 |
| 185 | Ac-LTF$r8HYWAQI$S-NH2 | 912 | 1597.87 | 799.94 | 800.07 |
| 186 | Ac-LTF$r8HYWAQNle$S-NH2 | 913 | 1597.87 | 799.94 | 800.07 |
| 187 | Ac-LTF$r8HYWAQL$A-NH2 | 914 | 1581.87 | 791.94 | 792.45 |
| 188 | Ac-LTF$r8HYWAQL$Abu-NH2 | 915 | 1595.89 | 798.95 | 799.03 |
| 189 | Ac-LTF$r8HYWAbuQL$S-NH2 | 916 | 1611.88 | 806.94 | 807.47 |
| 190 | Ac-LTF$er8AYWAQLSeS-NH2 | 917 | 1531.84 | 766.92 | 766.96 |
| 191 | Ac-LAF$r8HYWAQL$S-NH2 | 918 | 1567.86 | 784.93 | 785.49 |
| 192 | Ac-LAF$r8AYWAQL$S-NH2 | 919 | 1501.83 | 751.92 | 752.01 |
| 193 | Ac-LTF$er8AYWAQL$eA-NH2 | 920 | 1515.85 | 758.93 | 758.97 |
| 194 | Ac-LAF$r8AYWAQL$A-NH2 | 921 | 1485.84 | 743.92 | 744.05 |
| 195 | Ac-LTF$r8NLWANleL$Q-NH2 | 922 | 1550.92 | 776.46 | 776.61 |
| 196 | Ac-LTF$r8NLWANleL$A-NH2 | 923 | 1493.90 | 747.95 | 1495.6 |
| 197 | Ac-LTF$r8ALWANleL$Q-NH2 | 924 | 1507.92 | 754.96 | 755 |
| 198 | Ac-LAF$r8NLWANleL$Q-NH2 | 925 | 1520.91 | 761.46 | 761.96 |
| 199 | Ac-LAF$r8ALWANleL$A-NH2 | 926 | 1420.89 | 711.45 | 1421.74 |
| 200 | Ac-A$r8AYWEAc3cL$A-NH2 | 927 | 1238.67 | 620.34 | 1239.65 |
| 201 | Ac-F$r8AYWEAc3cL$AA-NH2 | 928 | 1385.74 | 693.87 | 1386.64 |
| 202 | Ac-F$r8AYWEAc3cL$Abu-NH2 | 929 | 1328.72 | 665.36 | 1330.17 |
| 203 | Ac-F$r8AYWEAc3cL$Nle-NH2 | 930 | 1356.75 | 679.38 | 1358.22 |
| 204 | Ac-F$r5AYWEAc3cL$s8A-NH2 | 931 | 1314.70 | 658.35 | 1315.51 |
| 205 | Ac-F$AYWEAc3cL$r8A-NH2 | 932 | 1314.70 | 658.35 | 1315.66 |
| 206 | Ac-F$r8AYWEAc3cl$A-NH2 | 933 | 1314.70 | 658.35 | 1316.18 |
| 207 | Ac-F$r8AYWEAc3cNle$A-NH2 | 934 | 1314.70 | 658.35 | 1315.66 |
| 208 | Ac-F$r8AYWEAmlL$A-NH2 | 935 | 1358.76 | 680.38 | 1360.21 |
| 209 | Ac-F$r8AYWENleL$A-NH2 | 936 | 1344.75 | 673.38 | 1345.71 |

TABLE 2B-continued

| Number | Sequence | SEQ ID NO: | Exact Mass | M + 2 | Observed mass (m/e) |
|---|---|---|---|---|---|
| 210 | Ac-F$r8AYWQAc3cL$A-NH2 | 937 | 1313.72 | 657.86 | 1314.7 |
| 211 | Ac-F$r8AYWAAc3cL$A-NH2 | 938 | 1256.70 | 629.35 | 1257.56 |
| 212 | Ac-F$r8AYWAbuAc3cL$A-NH2 | 939 | 1270.71 | 636.36 | 1272.14 |
| 213 | Ac-F$r8AYWNleAc3cL$A-NH2 | 940 | 1298.74 | 650.37 | 1299.67 |
| 214 | Ac-F$r8AbuYWEAc3cL$A-NH2 | 941 | 1328.72 | 665.36 | 1329.65 |
| 215 | Ac-F$r8NleYWEAc3cL$A-NH2 | 942 | 1356.75 | 679.38 | 1358.66 |
| 216 | 5-FAM-BaLTFEHYWAQLTS-NH2 | 943 | 1922.82 | 962.41 | 962.87 |
| 217 | 5-FAM-BaLTF%r8HYWAQL%S-NH2 | 944 | 1986.96 | 994.48 | 994.97 |
| 218 | Ac-LTF$r8HYWAQhL$S-NH2 | 945 | 1611.88 | 806.94 | 807 |
| 219 | Ac-LTF$r8HYWAQTle$S-NH2 | 946 | 1597.87 | 799.94 | 799.97 |
| 220 | Ac-LTF$r8HYWAQAdm$S-NH2 | 947 | 1675.91 | 838.96 | 839.09 |
| 221 | Ac-LTF$r8HYWAQhCha$S-NH2 | 948 | 1651.91 | 826.96 | 826.98 |
| 222 | Ac-LTF$r8HYWAQCha$S-NH2 | 949 | 1637.90 | 819.95 | 820.02 |
| 223 | Ac-LTF$r8HYWAc6cQL$S-NH2 | 950 | 1651.91 | 826.96 | 826.98 |
| 224 | Ac-LTF$r8HYWAc5cQL$S-NH2 | 951 | 1637.90 | 819.95 | 820.02 |
| 225 | Ac-LThF$r8HYWAQL$S-NH2 | 952 | 1611.88 | 806.94 | 807 |
| 226 | Ac-LTlgl$r8HYWAQL$S-NH2 | 953 | 1625.90 | 813.95 | 812.99 |
| 227 | Ac-LTF$r8HYWAQChg$S-NH2 | 954 | 1623.88 | 812.94 | 812.99 |
| 228 | Ac-LTF$r8HYWAQF$S-NH2 | 955 | 1631.85 | 816.93 | 816.99 |
| 229 | Ac-LTF$r8HYWAQlgl$S-NH2 | 956 | 1659.88 | 830.94 | 829.94 |
| 230 | Ac-LTF$r8HYWAQCba$S-NH2 | 957 | 1609.87 | 805.94 | 805.96 |
| 231 | Ac-LTF$r8HYWAQCpg$S-NH2 | 958 | 1609.87 | 805.94 | 805.96 |
| 232 | Ac-LTF$r8HhYWAQL$S-NH2 | 959 | 1611.88 | 806.94 | 807 |
| 233 | Ac-F$r8AYWEAc3chL$A-NH2 | 960 | 1328.72 | 665.36 | 665.43 |
| 234 | Ac-F$r8AYWEAc3cTle$A-NH2 | 961 | 1314.70 | 658.35 | 1315.62 |
| 235 | Ac-F$r8AYWEAc3cAdm$A-NH2 | 962 | 1392.75 | 697.38 | 697.47 |
| 236 | Ac-F$r8AYWEAc3chCha$A-NH2 | 963 | 1368.75 | 685.38 | 685.34 |
| 237 | Ac-F$r8AYWEAc3cCha$A-NH2 | 964 | 1354.73 | 678.37 | 678.38 |
| 238 | Ac-F$r8AYWEAc6cL$A-NH2 | 965 | 1356.75 | 679.38 | 679.42 |
| 239 | Ac-F$r8AYWEAc5cL$A-NH2 | 966 | 1342.73 | 672.37 | 672.46 |
| 240 | Ac-hF$r8AYWEAc3cL$A-NH2 | 967 | 1328.72 | 665.36 | 665.43 |
| 241 | Ac-Igl$r8AYWEAc3cL$A-NH2 | 968 | 1342.73 | 672.37 | 671.5 |
| 243 | Ac-F$r8AYWEAc3cF$A-NH2 | 969 | 1348.69 | 675.35 | 675.35 |
| 244 | Ac-F$r8AYWEAc3clgl$A-NH2 | 970 | 1376.72 | 689.36 | 688.37 |
| 245 | Ac-F$r8AYWEAc3cCba$A-NH2 | 971 | 1326.70 | 664.35 | 664.47 |
| 246 | Ac-F$r8AYWEAc3cCpg$A-NH2 | 972 | 1326.70 | 664.35 | 664.39 |
| 247 | Ac-F$r8AhYWEAc3cL$A-NH2 | 973 | 1328.72 | 665.36 | 665.43 |
| 248 | Ac-F$r8AYWEAc3cL$Q-NH2 | 974 | 1371.72 | 686.86 | 1372.87 |

TABLE 2B-continued

| Number | Sequence | SEQ ID NO: | Exact Mass | M + 2 | Observed mass (m/e) |
|---|---|---|---|---|---|
| 249 | Ac-F$r8AYWEAibL$A-NH2 | 975 | 1316.72 | 659.36 | 1318.18 |
| 250 | Ac-F$r8AYWEAL$A-NH2 | 976 | 1302.70 | 652.35 | 1303.75 |
| 251 | Ac-LAF$r8AYWAAL$A-NH2 | 977 | 1428.82 | 715.41 | 715.49 |
| 252 | Ac-LTF$r8HYWAAc3cL$S-NH2 | 978 | 1552.84 | 777.42 | 777.5 |
| 253 | Ac-NleTF$r8HYWAQL$S-NH2 | 979 | 1597.87 | 799.94 | 800.04 |
| 254 | Ac-VTF$r8HYWAQL$S-NH2 | 980 | 1583.85 | 792.93 | 793.04 |
| 255 | Ac-FTF$r8HYWAQL$S-NH2 | 981 | 1631.85 | 816.93 | 817.02 |
| 256 | Ac-WTF$r8HYWAQL$S-NH2 | 982 | 1670.86 | 836.43 | 836.85 |
| 257 | Ac-RTF$r8HYWAQL$S-NH2 | 983 | 1640.88 | 821.44 | 821.9 |
| 258 | Ac-KTF$r8HYWAQL$S-NH2 | 984 | 1612.88 | 807.44 | 807.91 |
| 259 | Ac-LNleF$r8HYWAQL$S-NH2 | 985 | 1609.90 | 805.95 | 806.43 |
| 260 | Ac-LVF$r8HYWAQL$S-NH2 | 986 | 1595.89 | 798.95 | 798.93 |
| 261 | Ac-LFF$r8HYWAQL$S-NH2 | 987 | 1643.89 | 822.95 | 823.38 |
| 262 | Ac-LWF$r8HYWAQL$S-NH2 | 988 | 1682.90 | 842.45 | 842.55 |
| 263 | Ac-LRF$r8HYWAQL$S-NH2 | 989 | 1652.92 | 827.46 | 827.52 |
| 264 | Ac-LKF$r8HYWAQL$S-NH2 | 990 | 1624.91 | 813.46 | 813.51 |
| 265 | Ac-LTF$r8NleYWAQL$S-NH2 | 991 | 1573.89 | 787.95 | 788.05 |
| 266 | Ac-LTF$r8VYWAQL$S-NH2 | 992 | 1559.88 | 780.94 | 780.98 |
| 267 | Ac-LTF$r8FYWAQL$S-NH2 | 993 | 1607.88 | 804.94 | 805.32 |
| 268 | Ac-LTF$r8WYWAQL$S-NH2 | 994 | 1646.89 | 824.45 | 824.86 |
| 269 | Ac-LTF$r8RYWAQL$S-NH2 | 995 | 1616.91 | 809.46 | 809.51 |
| 270 | Ac-LTF$r8KYWAQL$S-NH2 | 996 | 1588.90 | 795.45 | 795.48 |
| 271 | Ac-LTF$r8HNleWAQL$S-NH2 | 997 | 1547.89 | 774.95 | 774.98 |
| 272 | Ac-LTF$r8HVWAQL$S-NH2 | 998 | 1533.87 | 767.94 | 767.95 |
| 273 | Ac-LTF$r8HFWAQL$S-NH2 | 999 | 1581.87 | 791.94 | 792.3 |
| 274 | Ac-LTF$r8HWWAQL$S-NH2 | 1000 | 1620.88 | 811.44 | 811.54 |
| 275 | Ac-LTF$r8HRWAQL$S-NH2 | 1001 | 1590.90 | 796.45 | 796.52 |
| 276 | Ac-LTF$r8HKWAQL$S-NH2 | 1002 | 1562.90 | 782.45 | 782.53 |
| 277 | Ac-LTF$r8HYWNleQL$S-NH2 | 1003 | 1639.91 | 820.96 | 820.98 |
| 278 | Ac-LTF$r8HYWVQL$S-NH2 | 1004 | 1625.90 | 813.95 | 814.03 |
| 279 | Ac-LTF$r8HYWFQL$S-NH2 | 1005 | 1673.90 | 837.95 | 838.03 |
| 280 | Ac-LTF$r8HYWWQL$S-NH2 | 1006 | 1712.91 | 857.46 | 857.5 |
| 281 | Ac-LTF$r8HYWKQL$S-NH2 | 1007 | 1654.92 | 828.46 | 828.49 |
| 282 | Ac-LTF$r8HYWANleL$S-NH2 | 1008 | 1582.89 | 792.45 | 792.52 |
| 283 | Ac-LTF$r8HYWAVL$S-NH2 | 1009 | 1568.88 | 785.44 | 785.49 |
| 284 | Ac-LTF$r8HYWAFL$S-NH2 | 1010 | 1616.88 | 809.44 | 809.47 |
| 285 | Ac-LTF$r8HYWAWL$S-NH2 | 1011 | 1655.89 | 828.95 | 829 |
| 286 | Ac-LTF$r8HYWARL$S-NH2 | 1012 | 1625.91 | 813.96 | 813.98 |

TABLE 2B-continued

| Number | Sequence | SEQ ID NO: | Exact Mass | M + 2 | Observed mass (m/e) |
|---|---|---|---|---|---|
| 287 | Ac-LTF$r8HYWAQL$Nle-NH2 | 1013 | 1623.92 | 812.96 | 813.39 |
| 288 | Ac-LTF$r8HYWAQL$V-NH2 | 1014 | 1609.90 | 805.95 | 805.99 |
| 289 | Ac-LTF$r8HYWAQL$F-NH2 | 1015 | 1657.90 | 829.95 | 830.26 |
| 290 | Ac-LTF$r8HYWAQL$W-NH2 | 1016 | 1696.91 | 849.46 | 849.5 |
| 291 | Ac-LTF$r8HYWAQL$R-NH2 | 1017 | 1666.94 | 834.47 | 834.56 |
| 292 | Ac-LTF$r8HYWAQL$K-NH2 | 1018 | 1638.93 | 820.47 | 820.49 |
| 293 | Ac-Q$r8QQTFSN$WRLLAibQN-NH2 | 1019 | 2080.12 | 1041.06 | 1041.54 |
| 294 | Ac-QSQQ$r8FSNLWR$LAibQN-NH2 | 1020 | 2066.11 | 1034.06 | 1034.58 |
| 295 | Ac-LT2Pal$r8HYWAQL$S-NH2 | 1021 | 1598.86 | 800.43 | 800.49 |
| 296 | Ac-LT3Pal$r8HYWAQL$S-NH2 | 1022 | 1598.86 | 800.43 | 800.49 |
| 297 | Ac-LT4Pal$r8HYWAQL$S-NH2 | 1023 | 1598.86 | 800.43 | 800.49 |
| 298 | Ac-LTF2CF3$r8HYWAQL$S-NH2 | 1024 | 1665.85 | 833.93 | 834.01 |
| 299 | Ac-LTF2CN$r8HYWAQL$S-NH2 | 1025 | 1622.86 | 812.43 | 812.47 |
| 300 | Ac-LTF2Me$r8HYWAQL$S-NH2 | 1026 | 1611.88 | 806.94 | 807 |
| 301 | Ac-LTF3Cl$r8HYWAQL$S-NH2 | 1027 | 1631.83 | 816.92 | 816.99 |
| 302 | Ac-LTF4CF3$r8HYWAQL$S-NH2 | 1028 | 1665.85 | 833.93 | 833.94 |
| 303 | Ac-LTF4tBu$r8HYWAQL$S-NH2 | 1029 | 1653.93 | 827.97 | 828.02 |
| 304 | Ac-LTF5F$r8HYWAQL$S-NH2 | 1030 | 1687.82 | 844.91 | 844.96 |
| 305 | Ac-LTF$r8HY3BthAAQL$S-NH2 | 1031 | 1614.83 | 808.42 | 808.48 |
| 306 | Ac-LTF2Br$r8HYWAQL$S-NH2 | 1032 | 1675.78 | 838.89 | 838.97 |
| 307 | Ac-LTF4Br$r8HYWAQL$S-NH2 | 1033 | 1675.78 | 838.89 | 839.86 |
| 308 | Ac-LTF2Cl$r8HYWAQL$S-NH2 | 1034 | 1631.83 | 816.92 | 816.99 |
| 309 | Ac-LTF4Cl$r8HYWAQL$S-NH2 | 1035 | 1631.83 | 816.92 | 817.36 |
| 310 | Ac-LTF3CN$r8HYWAQL$S-NH2 | 1036 | 1622.86 | 812.43 | 812.47 |
| 311 | Ac-LTF4CN$r8HYWAQL$S-NH2 | 1037 | 1622.86 | 812.43 | 812.47 |
| 312 | Ac-LTF34Cl2$r8HYWAQL$S-NH2 | 1038 | 1665.79 | 833.90 | 833.94 |
| 313 | Ac-LTF34F2$r8HYWAQL$S-NH2 | 1039 | 1633.85 | 817.93 | 817.95 |
| 314 | Ac-LTF35F2$r8HYWAQL$S-NH2 | 1040 | 1633.85 | 817.93 | 817.95 |
| 315 | Ac-LTDip$r8HYWAQL$S-NH2 | 1041 | 1673.90 | 837.95 | 838.01 |
| 316 | Ac-LTF2F$r8HYWAQL$S-NH2 | 1042 | 1615.86 | 808.93 | 809 |
| 317 | Ac-LTF3F$r8HYWAQL$S-NH2 | 1043 | 1615.86 | 808.93 | 809 |
| 318 | Ac-LTF4F$r8HYWAQL$S-NH2 | 1044 | 1615.86 | 808.93 | 809 |
| 319 | Ac-LTF4I$r8HYWAQL$S-NH2 | 1045 | 1723.76 | 862.88 | 862.94 |
| 320 | Ac-LTF3Me$r8HYWAQL$S-NH2 | 1046 | 1611.88 | 806.94 | 807.07 |
| 321 | Ac-LTF4Me$r8HYWAQL$S-NH2 | 1047 | 1611.88 | 806.94 | 807 |
| 322 | Ac-LT1Nal$r8HYWAQL$S-NH2 | 1048 | 1647.88 | 824.94 | 824.98 |
| 323 | Ac-LT2Nal$r8HYWAQL$S-NH2 | 1049 | 1647.88 | 824.94 | 825.06 |
| 324 | Ac-LTF3CF3$r8HYWAQL$S-NH2 | 1050 | 1665.85 | 833.93 | 834.01 |

TABLE 2B-continued

| Number | Sequence | SEQ ID NO: | Exact Mass | M + 2 | Observed mass (m/e) |
|---|---|---|---|---|---|
| 325 | Ac-LTF4NO2$r8HYWAQL$S-NH2 | 1051 | 1642.85 | 822.43 | 822.46 |
| 326 | Ac-LTF3NO2$r8HYWAQL$S-NH2 | 1052 | 1642.85 | 822.43 | 822.46 |
| 327 | Ac-LTF$r82ThiYWAQL$S-NH2 | 1053 | 1613.83 | 807.92 | 807.96 |
| 328 | Ac-LTF$r8HBipWAQL$S-NH2 | 1054 | 1657.90 | 829.95 | 830.01 |
| 329 | Ac-LTF$r8HF4tBuWAQL$S-NH2 | 1055 | 1637.93 | 819.97 | 820.02 |
| 330 | Ac-LTF$r8HF4CF3WAQL$S-NH2 | 1056 | 1649.86 | 825.93 | 826.02 |
| 331 | Ac-LTF$r8HF4ClWAQL$S-NH2 | 1057 | 1615.83 | 808.92 | 809.37 |
| 332 | Ac-LTF$r8HF4MeWAQL$S-NH2 | 1058 | 1595.89 | 798.95 | 799.01 |
| 333 | Ac-LTF$r8HF4BrWAQL$S-NH2 | 1059 | 1659.78 | 830.89 | 830.98 |
| 334 | Ac-LTF$r8HF4CNWAQL$S-NH2 | 1060 | 1606.87 | 804.44 | 804.56 |
| 335 | Ac-LTF$r8HF4NO2WAQL$S-NH2 | 1061 | 1626.86 | 814.43 | 814.55 |
| 336 | Ac-LTF$r8H1NalWAQL$S-NH2 | 1062 | 1631.89 | 816.95 | 817.06 |
| 337 | Ac-LTF$r8H2NalWAQL$S-NH2 | 1063 | 1631.89 | 816.95 | 816.99 |
| 338 | Ac-LTF$r8HWAQL$S-NH2 | 1064 | 1434.80 | 718.40 | 718.49 |
| 339 | Ac-LTF$r8HY1NalAQL$S-NH2 | 1065 | 1608.87 | 805.44 | 805.52 |
| 340 | Ac-LTF$r8HY2NalAQL$S-NH2 | 1066 | 1608.87 | 805.44 | 805.52 |
| 341 | Ac-LTF$r8HYWAQI$S-NH2 | 1067 | 1597.87 | 799.94 | 800.07 |
| 342 | Ac-LTF$r8HYWAQNle$S-NH2 | 1068 | 1597.87 | 799.94 | 800.44 |
| 343 | Ac-LTF$er8HYWAQL$eA-NH2 | 1069 | 1581.87 | 791.94 | 791.98 |
| 344 | Ac-LTF$r8HYWAQL$Abu-NH2 | 1070 | 1595.89 | 798.95 | 799.03 |
| 345 | Ac-LTF$r8HYWAbuQL$S-NH2 | 1071 | 1611.88 | 806.94 | 804.47 |
| 346 | Ac-LAF$r8HYWAQL$S-NH2 | 1072 | 1567.86 | 784.93 | 785.49 |
| 347 | Ac-LTF$r8NLWANleL$Q-NH2 | 1073 | 1550.92 | 776.46 | 777.5 |
| 348 | Ac-LTF$r8ALWANleL$Q-NH2 | 1074 | 1507.92 | 754.96 | 755.52 |
| 349 | Ac-LAF$r8NLWANleL$Q-NH2 | 1075 | 1520.91 | 761.46 | 762.48 |
| 350 | Ac-F$r8AYWAAc3cL$A-NH2 | 1076 | 1256.70 | 629.35 | 1257.56 |
| 351 | Ac-LTF$r8AYWAAL$S-NH2 | 1077 | 1474.82 | 738.41 | 738.55 |
| 352 | Ac-LVF$r8AYWAQL$S-NH2 | 1078 | 1529.87 | 765.94 | 766 |
| 353 | Ac-LTF$r8AYWAbuQL$S-NH2 | 1079 | 1545.86 | 773.93 | 773.92 |
| 354 | Ac-LTF$r8AYWNleQL$S-NH2 | 1080 | 1573.89 | 787.95 | 788.17 |
| 355 | Ac-LTF$r8AbuYWAQL$S-NH2 | 1081 | 1545.86 | 773.93 | 773.99 |
| 356 | Ac-LTF$r8AYWHQL$S-NH2 | 1082 | 1597.87 | 799.94 | 799.97 |
| 357 | Ac-LTF$r8AYWKQL$S-NH2 | 1083 | 1588.90 | 795.45 | 795.53 |
| 358 | Ac-LTF$r8AYWOQL$S-NH2 | 1084 | 1574.89 | 788.45 | 788.5 |
| 359 | Ac-LTF$r8AYWRQL$S-NH2 | 1085 | 1616.91 | 809.46 | 809.51 |
| 360 | Ac-LTF$r8AYWSQL$S-NH2 | 1086 | 1547.84 | 774.92 | 774.96 |
| 361 | Ac-LTF$r8AYWRAL$S-NH2 | 1087 | 1559.89 | 780.95 | 780.95 |
| 362 | Ac-LTF$r8AYWRQL$A-NH2 | 1088 | 1600.91 | 801.46 | 801.52 |

TABLE 2B-continued

| Number | Sequence | SEQ ID NO: | Exact Mass | M + 2 | Observed mass (m/e) |
|---|---|---|---|---|---|
| 363 | Ac-LTF$r8AYWRAL$A-NH2 | 1089 | 1543.89 | 772.95 | 773.03 |
| 364 | Ac-LTF$r5HYWAQL$s8S-NH2 | 1090 | 1597.87 | 799.94 | 799.97 |
| 365 | Ac-LTF$HYWAQL$r8S-NH2 | 1091 | 1597.87 | 799.94 | 799.97 |
| 366 | Ac-LTF$r8HYWAAL$S-NH2 | 1092 | 1540.84 | 771.42 | 771.48 |
| 367 | Ac-LTF$r8HYWAAbuL$S-NH2 | 1093 | 1554.86 | 778.43 | 778.51 |
| 368 | Ac-LTF$r8HYWALL$S-NH2 | 1094 | 1582.89 | 792.45 | 792.49 |
| 369 | Ac-F$r8AYWHAL$A-NH2 | 1095 | 1310.72 | 656.36 | 656.4 |
| 370 | Ac-F$r8AYWAAL$A-NH2 | 1096 | 1244.70 | 623.35 | 1245.61 |
| 371 | Ac-F$r8AYWSAL$A-NH2 | 1097 | 1260.69 | 631.35 | 1261.6 |
| 372 | Ac-F$r8AYWRAL$A-NH2 | 1098 | 1329.76 | 665.88 | 1330.72 |
| 373 | Ac-F$r8AYWKAL$A-NH2 | 1099 | 1301.75 | 651.88 | 1302.67 |
| 374 | Ac-F$r8AYWOAL$A-NH2 | 1100 | 1287.74 | 644.87 | 1289.13 |
| 375 | Ac-F$r8VYWEAc3cL$A-NH2 | 1101 | 1342.73 | 672.37 | 1343.67 |
| 376 | Ac-F$r8FYWEAc3cL$A-NH2 | 1102 | 1390.73 | 696.37 | 1392.14 |
| 377 | Ac-F$r8WYWEAc3cL$A-NH2 | 1103 | 1429.74 | 715.87 | 1431.44 |
| 378 | Ac-F$r8RYWEAc3cL$A-NH2 | 1104 | 1399.77 | 700.89 | 700.95 |
| 379 | Ac-F$r8KYWEAc3cL$A-NH2 | 1105 | 1371.76 | 686.88 | 686.97 |
| 380 | Ac-F$r8ANleWEAc3cL$A-NH2 | 1106 | 1264.72 | 633.36 | 1265.59 |
| 381 | Ac-F$r8AVWEAc3cL$A-NH2 | 1107 | 1250.71 | 626.36 | 1252.2 |
| 382 | Ac-F$r8AFWEAc3cL$A-NH2 | 1108 | 1298.71 | 650.36 | 1299.64 |
| 383 | Ac-F$r8AWWEAc3cL$A-NH2 | 1109 | 1337.72 | 669.86 | 1338.64 |
| 384 | Ac-F$r8ARWEAc3cL$A-NH2 | 1110 | 1307.74 | 654.87 | 655 |
| 385 | Ac-F$r8AKWEAc3cL$A-NH2 | 1111 | 1279.73 | 640.87 | 641.01 |
| 386 | Ac-F$r8AYWVAc3cL$A-NH2 | 1112 | 1284.73 | 643.37 | 643.38 |
| 387 | Ac-F$r8AYWFAc3cL$A-NH2 | 1113 | 1332.73 | 667.37 | 667.43 |
| 388 | Ac-F$r8AYWWAc3cL$A-NH2 | 1114 | 1371.74 | 686.87 | 686.97 |
| 389 | Ac-F$r8AYWRAc3cL$A-NH2 | 1115 | 1341.76 | 671.88 | 671.94 |
| 390 | Ac-F$r8AYWKAc3cL$A-NH2 | 1116 | 1313.75 | 657.88 | 657.88 |
| 391 | Ac-F$r8AYWEVLSA-NH2 | 1117 | 1330.73 | 666.37 | 666.47 |
| 392 | Ac-F$r8AYWEFL$A-NH2 | 1118 | 1378.73 | 690.37 | 690.44 |
| 393 | Ac-F$r8AYWEWL$A-NH2 | 1119 | 1417.74 | 709.87 | 709.91 |
| 394 | Ac-F$r8AYWERL$A-NH2 | 1120 | 1387.77 | 694.89 | 1388.66 |
| 395 | Ac-F$r8AYWEKL$A-NH2 | 1121 | 1359.76 | 680.88 | 1361.21 |
| 396 | Ac-F$r8AYWEAc3cL$V-NH2 | 1122 | 1342.73 | 672.37 | 1343.59 |
| 397 | Ac-F$r8AYWEAc3cL$F-NH2 | 1123 | 1390.73 | 696.37 | 1392.58 |
| 398 | Ac-F$r8AYWEAc3cL$W-NH2 | 1124 | 1429.74 | 715.87 | 1431.29 |
| 399 | Ac-F$r8AYWEAc3cL$R-NH2 | 1125 | 1399.77 | 700.89 | 700.95 |
| 400 | Ac-F$r8AYWEAc3cL$K-NH2 | 1126 | 1371.76 | 686.88 | 686.97 |

TABLE 2B-continued

| Number | Sequence | SEQ ID NO: | Exact Mass | M + 2 | Observed mass (m/e) |
|---|---|---|---|---|---|
| 401 | Ac-F$r8AYWEAc3cL$AV-NH2 | 1127 | 1413.77 | 707.89 | 707.91 |
| 402 | Ac-F$r8AYWEAc3cL$AF-NH2 | 1128 | 1461.77 | 731.89 | 731.96 |
| 403 | Ac-F$r8AYWEAc3cL$AW-NH2 | 1129 | 1500.78 | 751.39 | 751.5 |
| 404 | Ac-F$r8AYWEAc3cL$AR-NH2 | 1130 | 1470.80 | 736.40 | 736.47 |
| 405 | Ac-F$r8AYWEAc3cL$AK-NH2 | 1131 | 1442.80 | 722.40 | 722.41 |
| 406 | Ac-F$r8AYWEAc3cL$AH-NH2 | 1132 | 1451.76 | 726.88 | 726.93 |
| 407 | Ac-LTF2NO2$r8HYWAQL$S-NH2 | 1133 | 1642.85 | 822.43 | 822.54 |
| 408 | Ac-LTA$r8HYAAQL$S-NH2 | 1134 | 1406.79 | 704.40 | 704.5 |
| 409 | Ac-LTF$r8HYAAQL$S-NH2 | 1135 | 1482.82 | 742.41 | 742.47 |
| 410 | Ac-QSQQTF$r8NLWALL$AN-NH2 | 1136 | 1966.07 | 984.04 | 984.38 |
| 411 | Ac-QAibQQTF$r8NLWALL$AN-NH2 | 1137 | 1964.09 | 983.05 | 983.42 |
| 412 | Ac-QAibQQTF$r8ALWALL$AN-NH2 | 1138 | 1921.08 | 961.54 | 961.59 |
| 413 | Ac-AAAATF$r8AAWAAL$AA-NH2 | 1139 | 1608.90 | 805.45 | 805.52 |
| 414 | Ac-F$r8AAWRAL$Q-NH2 | 1140 | 1294.76 | 648.38 | 648.48 |
| 415 | Ac-TF$r8AAWAAL$Q-NH2 | 1141 | 1310.74 | 656.37 | 1311.62 |
| 416 | Ac-TF$r8AAWRAL$A-NH2 | 1142 | 1338.78 | 670.39 | 670.46 |
| 417 | Ac-VF$r8AAWRAL$Q-NH2 | 1143 | 1393.82 | 697.91 | 697.99 |
| 418 | Ac-AF$r8AAWAAL$A-NH2 | 1144 | 1223.71 | 612.86 | 1224.67 |
| 420 | Ac-TF$r8AAWKAL$Q-NH2 | 1145 | 1367.80 | 684.90 | 684.97 |
| 421 | Ac-TF$r8AAWOAL$Q-NH2 | 1146 | 1353.78 | 677.89 | 678.01 |
| 422 | Ac-TF$r8AAWSAL$Q-NH2 | 1147 | 1326.73 | 664.37 | 664.47 |
| 423 | Ac-LTF$r8AAWRAL$Q-NH2 | 1148 | 1508.89 | 755.45 | 755.49 |
| 424 | Ac-F$r8AYWAQL$A-NH2 | 1149 | 1301.72 | 651.86 | 651.96 |
| 425 | Ac-F$r8AWWAAL$A-NH2 | 1150 | 1267.71 | 634.86 | 634.87 |
| 426 | Ac-F$r8AWWAQL$A-NH2 | 1151 | 1324.73 | 663.37 | 663.43 |
| 427 | Ac-F$r8AYWEAL$-NH2 | 1152 | 1231.66 | 616.83 | 1232.93 |
| 428 | Ac-F$r8AYWAAL$-NH2 | 1153 | 1173.66 | 587.83 | 1175.09 |
| 429 | Ac-F$r8AYWKAL$-NH2 | 1154 | 1230.72 | 616.36 | 616.44 |
| 430 | Ac-F$r8AYWOAL$-NH2 | 1155 | 1216.70 | 609.35 | 609.48 |
| 431 | Ac-F$r8AYWQAL$-NH2 | 1156 | 1230.68 | 616.34 | 616.44 |
| 432 | Ac-F$r8AYWAQL$-NH2 | 1157 | 1230.68 | 616.34 | 616.37 |
| 433 | Ac-F$r8HYWDQL$S-NH2 | 1158 | 1427.72 | 714.86 | 714.86 |
| 434 | Ac-F$r8HFWEQL$S-NH2 | 1159 | 1425.74 | 713.87 | 713.98 |
| 435 | Ac-F$r8AYWHQL$S-NH2 | 1160 | 1383.73 | 692.87 | 692.96 |
| 436 | Ac-F$r8AYWKQL$S-NH2 | 1161 | 1374.77 | 688.39 | 688.45 |
| 437 | Ac-F$r8AYWOQL$S-NH2 | 1162 | 1360.75 | 681.38 | 681.49 |
| 438 | Ac-F$r8HYWSQL$S-NH2 | 1163 | 1399.73 | 700.87 | 700.95 |
| 439 | Ac-F$r8HWWEQL$S-NH2 | 1164 | 1464.76 | 733.38 | 733.44 |

TABLE 2B-continued

| Number | Sequence | SEQ ID NO: | Exact Mass | M + 2 | Observed mass (m/e) |
|---|---|---|---|---|---|
| 440 | Ac-F$r8HWWAQL$S-NH2 | 1165 | 1406.75 | 704.38 | 704.43 |
| 441 | Ac-F$r8AWWHQL$S-NH2 | 1166 | 1406.75 | 704.38 | 704.43 |
| 442 | Ac-F$r8AWWKQL$S-NH2 | 1167 | 1397.79 | 699.90 | 699.92 |
| 443 | Ac-F$r8AWWOQL$S-NH2 | 1168 | 1383.77 | 692.89 | 692.96 |
| 444 | Ac-F$r8HWWSQL$S-NH2 | 1169 | 1422.75 | 712.38 | 712.42 |
| 445 | Ac-LTF$r8NYWANleL$Q-NH2 | 1170 | 1600.90 | 801.45 | 801.52 |
| 446 | Ac-LTF$r8NLWAQL$Q-NH2 | 1171 | 1565.90 | 783.95 | 784.06 |
| 447 | Ac-LTF$r8NYWANleL$A-NH2 | 1172 | 1543.88 | 772.94 | 773.03 |
| 448 | Ac-LTF$r8NLWAQL$A-NH2 | 1173 | 1508.88 | 755.44 | 755.49 |
| 449 | Ac-LTF$r8AYWANleL$Q-NH2 | 1174 | 1557.90 | 779.95 | 780.06 |
| 450 | Ac-LTF$r8ALWAQL$Q-NH2 | 1175 | 1522.89 | 762.45 | 762.45 |
| 451 | Ac-LAF$r8NYWANleL$Q-NH2 | 1176 | 1570.89 | 786.45 | 786.5 |
| 452 | Ac-LAF$r8NLWAQL$Q-NH2 | 1177 | 1535.89 | 768.95 | 769.03 |
| 453 | Ac-LAF$r8AYWANleL$A-NH2 | 1178 | 1470.86 | 736.43 | 736.47 |
| 454 | Ac-LAF$r8ALWAQL$A-NH2 | 1179 | 1435.86 | 718.93 | 719.01 |
| 455 | Ac-LAF$r8AYWAAL$A-NH2 | 1180 | 1428.82 | 715.41 | 715.41 |
| 456 | Ac-F$r8AYWEAc3cL$AAib-NH2 | 1181 | 1399.75 | 700.88 | 700.95 |
| 457 | Ac-F$r8AYWAQL$AA-NH2 | 1182 | 1372.75 | 687.38 | 687.78 |
| 458 | Ac-F$r8AYWAAc3cL$AA-NH2 | 1183 | 1327.73 | 664.87 | 664.84 |
| 459 | Ac-F$r8AYWSAc3cL$AA-NH2 | 1184 | 1343.73 | 672.87 | 672.9 |
| 460 | Ac-F$r8AYWEAc3cL$AS-NH2 | 1185 | 1401.73 | 701.87 | 701.84 |
| 461 | Ac-F$r8AYWEAc3cL$AT-NH2 | 1186 | 1415.75 | 708.88 | 708.87 |
| 462 | Ac-F$r8AYWEAc3cL$AL-NH2 | 1187 | 1427.79 | 714.90 | 714.94 |
| 463 | Ac-F$r8AYWEAc3cL$AQ-NH2 | 1188 | 1442.76 | 722.38 | 722.41 |
| 464 | Ac-F$r8AFWEAc3cL$AA-NH2 | 1189 | 1369.74 | 685.87 | 685.93 |
| 465 | Ac-F$r8AWWEAc3cL$AA-NH2 | 1190 | 1408.75 | 705.38 | 705.39 |
| 466 | Ac-F$r8AYWEAc3cL$SA-NH2 | 1191 | 1401.73 | 701.87 | 701.99 |
| 467 | Ac-F$r8AYWEAL$AA-NH2 | 1192 | 1373.74 | 687.87 | 687.93 |
| 468 | Ac-F$r8AYWENleL$AA-NH2 | 1193 | 1415.79 | 708.90 | 708.94 |
| 469 | Ac-F$r8AYWEAc3cL$AbuA-NH2 | 1194 | 1399.75 | 700.88 | 700.95 |
| 470 | Ac-F$r8AYWEAc3cL$NleA-NH2 | 1195 | 1427.79 | 714.90 | 714.86 |
| 471 | Ac-F$r8AYWEAibL$NleA-NH2 | 1196 | 1429.80 | 715.90 | 715.97 |
| 472 | Ac-F$r8AYWEAL$NleA-NH2 | 1197 | 1415.79 | 708.90 | 708.94 |
| 473 | Ac-F$r8AYWENleL$NleA-NH2 | 1198 | 1457.83 | 729.92 | 729.96 |
| 474 | Ac-F$r8AYWEAibL$Abu-NH2 | 1199 | 1330.73 | 666.37 | 666.39 |
| 475 | Ac-F$r8AYWENleL$Abu-NH2 | 1200 | 1358.76 | 680.38 | 680.39 |
| 476 | Ac-F$r8AYWEAL$Abu-NH2 | 1201 | 1316.72 | 659.36 | 659.36 |
| 477 | Ac-LTF$r8AFWAQL$S-NH2 | 1202 | 1515.85 | 758.93 | 759.12 |

TABLE 2B-continued

| Number | Sequence | SEQ ID NO: | Exact Mass | M + 2 | Observed mass (m/e) |
|---|---|---|---|---|---|
| 478 | Ac-LTF$r8AWWAQL$S-NH2 | 1203 | 1554.86 | 778.43 | 778.51 |
| 479 | Ac-LTF$r8AYWAQI$S-NH2 | 1204 | 1531.84 | 766.92 | 766.96 |
| 480 | Ac-LTF$r8AYWAQNle$S-NH2 | 1205 | 1531.84 | 766.92 | 766.96 |
| 481 | Ac-LTF$r8AYWAQL$SA-NH2 | 1206 | 1602.88 | 802.44 | 802.48 |
| 482 | Ac-LTF$r8AWWAQL$A-NH2 | 1207 | 1538.87 | 770.44 | 770.89 |
| 483 | Ac-LTF$r8AYWAQI$A-NH2 | 1208 | 1515.85 | 758.93 | 759.42 |
| 484 | Ac-LTF$r8AYWAQNle$A-NH2 | 1209 | 1515.85 | 758.93 | 759.42 |
| 485 | Ac-LTF$r8AYWAQL$AA-NH2 | 1210 | 1586.89 | 794.45 | 794.94 |
| 486 | Ac-LTF$r8HWWAQL$S-NH2 | 1211 | 1620.88 | 811.44 | 811.47 |
| 487 | Ac-LTF$r8HRWAQL$S-NH2 | 1212 | 1590.90 | 796.45 | 796.52 |
| 488 | Ac-LTF$r8HKWAQL$S-NH2 | 1213 | 1562.90 | 782.45 | 782.53 |
| 489 | Ac-LTF$r8HYWAQL$W-NH2 | 1214 | 1696.91 | 849.46 | 849.5 |
| 491 | Ac-F$r8AYWAbuAL$A-NH2 | 1215 | 1258.71 | 630.36 | 630.5 |
| 492 | Ac-F$r8AbuYWEAL$A-NH2 | 1216 | 1316.72 | 659.36 | 659.51 |
| 493 | Ac-NlePRF%r8NYWRLL%QN-NH2 | 1217 | 1954.13 | 978.07 | 978.54 |
| 494 | Ac-TSF$r8HYWAQL%S-NH2 | 1218 | 1573.83 | 787.92 | 787.98 |
| 495 | Ac-LTF%r8AYWAQL%S-NH2 | 1219 | 1533.86 | 767.93 | 768 |
| 496 | Ac-HTF$r8HYWAQL$S-NH2 | 1220 | 1621.84 | 811.92 | 811.96 |
| 497 | Ac-LHF$r8HYWAQL$S-NH2 | 1221 | 1633.88 | 817.94 | 818.02 |
| 498 | Ac-LTF$r8HHWAQL$S-NH2 | 1222 | 1571.86 | 786.93 | 786.94 |
| 499 | Ac-LTF$r8HYWHQL$S-NH2 | 1223 | 1663.89 | 832.95 | 832.38 |
| 500 | Ac-LTF$r8HYWAHL$S-NH2 | 1224 | 1606.87 | 804.44 | 804.48 |
| 501 | Ac-LTF$r8HYWAQL$H-NH2 | 1225 | 1647.89 | 824.95 | 824.98 |
| 502 | Ac-LTF$r8HYWAQL$S-NHPr | 1226 | 1639.91 | 820.96 | 820.98 |
| 503 | Ac-LTF$r8HYWAQL$S-NHsBu | 1227 | 1653.93 | 827.97 | 828.02 |
| 504 | Ac-LTF$r8HYWAQL$S-NHiBu | 1228 | 1653.93 | 827.97 | 828.02 |
| 505 | Ac-LTF$r8HYWAQL$S-NHBn | 1229 | 1687.91 | 844.96 | 844.44 |
| 506 | Ac-LTF$r8HYWAQL$S-NHPe | 1230 | 1700.92 | 851.46 | 851.99 |
| 507 | Ac-LTF$r8HYWAQL$S-NHChx | 1231 | 1679.94 | 840.97 | 841.04 |
| 508 | Ac-ETF$r8AYWAQL$S-NH2 | 1232 | 1547.80 | 774.90 | 774.96 |
| 509 | Ac-STF$r8AYWAQL$S-NH2 | 1233 | 1505.79 | 753.90 | 753.94 |
| 510 | Ac-LEF$r8AYWAQL$S-NH2 | 1234 | 1559.84 | 780.92 | 781.25 |
| 511 | Ac-LSF$r8AYWAQL$S-NH2 | 1235 | 1517.83 | 759.92 | 759.93 |
| 512 | Ac-LTF$r8EYWAQL$S-NH2 | 1236 | 1589.85 | 795.93 | 795.97 |
| 513 | Ac-LTF$r8SYWAQL$S-NH2 | 1237 | 1547.84 | 774.92 | 774.96 |
| 514 | Ac-LTF$r8AYWEQL$S-NH2 | 1238 | 1589.85 | 795.93 | 795.9 |
| 515 | Ac-LTF$r8AYWAEL$S-NH2 | 1239 | 1532.83 | 767.42 | 766.96 |
| 516 | Ac-LTF$r8AYWASL$S-NH2 | 1240 | 1490.82 | 746.41 | 746.46 |

TABLE 2B-continued

| Number | Sequence | SEQ ID NO: | Exact Mass | M + 2 | Observed mass (m/e) |
|---|---|---|---|---|---|
| 517 | Ac-LTF$r8AYWAQL$E-NH2 | 1241 | 1573.85 | 787.93 | 787.98 |
| 518 | Ac-LTF2CN$r8HYWAQL$S-NH2 | 1242 | 1622.86 | 812.43 | 812.47 |
| 519 | Ac-LTF3Cl$r8HYWAQL$S-NH2 | 1243 | 1631.83 | 816.92 | 816.99 |
| 520 | Ac-LTDip$r8HYWAQL$S-NH2 | 1244 | 1673.90 | 837.95 | 838.01 |
| 521 | Ac-LTF$r8HYWAQTle$S-NH2 | 1245 | 1597.87 | 799.94 | 800.04 |
| 522 | Ac-F$r8AY6clWEAL$A-NH2 | 1246 | 1336.66 | 669.33 | 1338.56 |
| 523 | Ac-F$r8AYdl6brWEAL$A-NH2 | 1247 | 1380.61 | 691.31 | 692.2 |
| 524 | Ac-F$r8AYdl6fWEAL$A-NH2 | 1248 | 1320.69 | 661.35 | 1321.61 |
| 525 | Ac-F$r8AYdl4mWEAL$A-NH2 | 1249 | 1316.72 | 659.36 | 659.36 |
| 526 | Ac-F$r8AYdl5clWEAL$A-NH2 | 1250 | 1336.66 | 669.33 | 669.35 |
| 527 | Ac-F$r8AYdl7mWEAL$A-NH2 | 1251 | 1316.72 | 659.36 | 659.36 |
| 528 | Ac-LTF%r8HYWAQL%A-NH2 | 1252 | 1583.89 | 792.95 | 793.01 |
| 529 | Ac-LTF$r8HCouWAQL$S-NH2 | 1253 | 1679.87 | 840.94 | 841.38 |
| 530 | Ac-LTFEHCouWAQLTS-NH2 | 1254 | 1617.75 | 809.88 | 809.96 |
| 531 | Ac-LTA$r8HCouWAQL$S-NH2 | 1255 | 1603.84 | 802.92 | 803.36 |
| 532 | Ac-F$r8AYWEAL$AbuA-NH2 | 1256 | 1387.75 | 694.88 | 694.88 |
| 533 | Ac-F$r8AYWEAISAA-NH2 | 1257 | 1373.74 | 687.87 | 687.93 |
| 534 | Ac-F$r8AYWEANle$AA-NH2 | 1258 | 1373.74 | 687.87 | 687.93 |
| 535 | Ac-F$r8AYWEAmIL$AA-NH2 | 1259 | 1429.80 | 715.90 | 715.97 |
| 536 | Ac-F$r8AYWQAL$AA-NH2 | 1260 | 1372.75 | 687.38 | 687.48 |
| 537 | Ac-F$r8AYWAAL$AA-NH2 | 1261 | 1315.73 | 658.87 | 658.92 |
| 538 | Ac-F$r8AYWAbuAL$AA-NH2 | 1262 | 1329.75 | 665.88 | 665.95 |
| 539 | Ac-F$r8AYWNleAL$AA-NH2 | 1263 | 1357.78 | 679.89 | 679.94 |
| 540 | Ac-F$r8AbuYWEAL$AA-NH2 | 1264 | 1387.75 | 694.88 | 694.96 |
| 541 | Ac-F$r8NleYWEAL$AA-NH2 | 1265 | 1415.79 | 708.90 | 708.94 |
| 542 | Ac-F$r8FYWEAL$AA-NH2 | 1266 | 1449.77 | 725.89 | 725.97 |
| 543 | Ac-LTF$r8HYWAQhL$S-NH2 | 1267 | 1611.88 | 806.94 | 807 |
| 544 | Ac-LTF$r8HYWAQAdm$S-NH2 | 1268 | 1675.91 | 838.96 | 839.04 |
| 545 | Ac-LTF$r8HYWAQlgl$S-NH2 | 1269 | 1659.88 | 830.94 | 829.94 |
| 546 | Ac-F$r8AYWAQL$AA-NH2 | 1270 | 1372.75 | 687.38 | 687.48 |
| 547 | Ac-LTF$r8ALWAQL$Q-NH2 | 1271 | 1522.89 | 762.45 | 762.52 |
| 548 | Ac-F$r8AYWEAL$AA-NH2 | 1272 | 1373.74 | 687.87 | 687.93 |
| 549 | Ac-F$r8AYWENleL$AA-NH2 | 1273 | 1415.79 | 708.90 | 708.94 |
| 550 | Ac-F$r8AYWEAibL$Abu-NH2 | 1274 | 1330.73 | 666.37 | 666.39 |
| 551 | Ac-F$r8AYWENleL$Abu-NH2 | 1275 | 1358.76 | 680.38 | 680.38 |
| 552 | Ac-F$r8AYWEAL$Abu-NH2 | 1276 | 1316.72 | 659.36 | 659.36 |
| 553 | Ac-F$r8AYWEAc3cL$AbuA-NH2 | 1277 | 1399.75 | 700.88 | 700.95 |
| 554 | Ac-F$r8AYWEAc3cL$NleA-NH2 | 1278 | 1427.79 | 714.90 | 715.01 |

TABLE 2B-continued

| Number | Sequence | SEQ ID NO: | Exact Mass | M + 2 | Observed mass (m/e) |
|---|---|---|---|---|---|
| 555 | H-LTF$r8AYWAQL$S-NH2 | 1279 | 1489.83 | 745.92 | 745.95 |
| 556 | mdPEG3-LTF$r8AYWAQL$S-NH2 | 1280 | 1679.92 | 840.96 | 840.97 |
| 557 | mdPEG7-LTF$r8AYWAQL$S-NH2 | 1281 | 1856.02 | 929.01 | 929.03 |
| 558 | Ac-F$r8AompEt6clWEAL$A-NH2 | 1282 | 1470.71 | 736.36 | 788.17 |
| 559 | Ac-LTF3Cl$r8AYWAQL$S-NH2 | 1283 | 1565.81 | 783.91 | 809.18 |
| 560 | Ac-LTF3Cl$r8HYWAQL$A-NH2 | 1284 | 1615.83 | 808.92 | 875.24 |
| 561 | Ac-LTF3Cl$r8HYWWQL$S-NH2 | 1285 | 1746.87 | 874.44 | 841.65 |
| 562 | Ac-LTF3Cl$r8AYWWQL$S-NH2 | 1286 | 1680.85 | 841.43 | 824.63 |
| 563 | Ac-LTF$r8AYWWQL$S-NH2 | 1287 | 1646.89 | 824.45 | 849.98 |
| 564 | Ac-LTF$r8HYWWQL$A-NH2 | 1288 | 1696.91 | 849.46 | 816.67 |
| 565 | Ac-LTF$r8AYWWQL$A-NH2 | 1289 | 1630.89 | 816.45 | 776.15 |
| 566 | Ac-LTF4F$r8AYWAQL$S-NH2 | 1290 | 1549.83 | 775.92 | 776.15 |
| 567 | Ac-LTF2F$r8AYWAQL$S-NH2 | 1291 | 1549.83 | 775.92 | 776.15 |
| 568 | Ac-LTF3F$r8AYWAQL$S-NH2 | 1292 | 1549.83 | 775.92 | 785.12 |
| 569 | Ac-LTF34F2$r8AYWAQL$S-NH2 | 1293 | 1567.83 | 784.92 | 785.12 |
| 570 | Ac-LTF35F2$r8AYWAQL$S-NH2 | 1294 | 1567.83 | 784.92 | 1338.74 |
| 571 | Ac-F3Cl$r8AYWEAL$A-NH2 | 1295 | 1336.66 | 669.33 | 705.28 |
| 572 | Ac-F3Cl$r8AYWEAL$AA-NH2 | 1296 | 1407.70 | 704.85 | 680.11 |
| 573 | Ac-F$r8AY6clWEAL$AA-NH2 | 1297 | 1407.70 | 704.85 | 736.83 |
| 574 | Ac-F$r8AY6clWEAL$-NH2 | 1298 | 1265.63 | 633.82 | 784.1 |
| 575 | Ac-LTF$r8HYWAQLSt/S-NH2 | 1299 | 16.03 | 9.02 | 826.98 |
| 576 | Ac-LTF$r8HYWAQL$S-NHsBu | 1300 | 1653.93 | 827.97 | 828.02 |
| 577 | Ac-STF$r8AYWAQL$S-NH2 | 1301 | 1505.79 | 753.90 | 753.94 |
| 578 | Ac-LTF$r8AYWAEL$S-NH2 | 1302 | 1532.83 | 767.42 | 767.41 |
| 579 | Ac-LTF$r8AYWAQL$E-NH2 | 1303 | 1573.85 | 787.93 | 787.98 |
| 580 | mdPEG3-LTF$r8AYWAQL$S-NH2 | 1304 | 1679.92 | 840.96 | 840.97 |
| 581 | Ac-LTF$r8AYWAQhL$S-NH2 | 1305 | 1545.86 | 773.93 | 774.31 |
| 583 | Ac-LTF$r8AYWAQCha$S-NH2 | 1306 | 1571.88 | 786.94 | 787.3 |
| 584 | Ac-LTF$r8AYWAQChg$S-NH2 | 1307 | 1557.86 | 779.93 | 780.4 |
| 585 | Ac-LTF$r8AYWAQCba$S-NH2 | 1308 | 1543.84 | 772.92 | 780.13 |
| 586 | Ac-LTF$r8AYWAQF$S-NH2 | 1309 | 1565.83 | 783.92 | 784.2 |
| 587 | Ac-LTF4F$r8HYWAQhL$S-NH2 | 1310 | 1629.87 | 815.94 | 815.36 |
| 588 | Ac-LTF4F$r8HYWAQCha$S-NH2 | 1311 | 1655.89 | 828.95 | 828.39 |
| 589 | Ac-LTF4F$r8HYWAQChg$S-NH2 | 1312 | 1641.87 | 821.94 | 821.35 |
| 590 | Ac-LTF4F$r8HYWAQCba$S-NH2 | 1313 | 1627.86 | 814.93 | 814.32 |
| 591 | Ac-LTF4F$r8AYWAQhL$S-NH2 | 1314 | 1563.85 | 782.93 | 782.36 |
| 592 | Ac-LTF4F$r8AYWAQCha$S-NH2 | 1315 | 1589.87 | 795.94 | 795.38 |
| 593 | Ac-LTF4F$r8AYWAQChg$S-NH2 | 1316 | 1575.85 | 788.93 | 788.35 |

TABLE 2B-continued

| Number | Sequence | SEQ ID NO: | Exact Mass | M + 2 | Observed mass (m/e) |
|---|---|---|---|---|---|
| 594 | Ac-LTF4F$r8AYWAQCba$S-NH2 | 1317 | 1561.83 | 781.92 | 781.39 |
| 595 | Ac-LTF3Cl$r8AYWAQhL$S-NH2 | 1318 | 1579.82 | 790.91 | 790.35 |
| 596 | Ac-LTF3Cl$r8AYWAQCha$S-NH2 | 1319 | 1605.84 | 803.92 | 803.67 |
| 597 | Ac-LTF3Cl$r8AYWAQChg$S-NH2 | 1320 | 1591.82 | 796.91 | 796.34 |
| 598 | Ac-LTF3Cl$r8AYWAQCba$S-NH2 | 1321 | 1577.81 | 789.91 | 789.39 |
| 599 | Ac-LTF$r8AYWAQhF$S-NH2 | 1322 | 1579.84 | 790.92 | 791.14 |
| 600 | Ac-LTF$r8AYWAQF3CF3$S-NH2 | 1323 | 1633.82 | 817.91 | 818.15 |
| 601 | Ac-LTF$r8AYWAQF3Me$S-NH2 | 1324 | 1581.86 | 791.93 | 791.32 |
| 602 | Ac-LTF$r8AYWAQ1Nal$S-NH2 | 1325 | 1615.84 | 808.92 | 809.18 |
| 603 | Ac-LTF$r8AYWAQBip$S-NH2 | 1326 | 1641.86 | 821.93 | 822.13 |
| 604 | Ac-LTF$r8FYWAQL$A-NH2 | 1327 | 1591.88 | 796.94 | 797.33 |
| 605 | Ac-LTF$r8HYWAQL$S-NHAm | 1328 | 1667.94 | 834.97 | 835.92 |
| 606 | Ac-LTF$r8HYWAQL$S-NHiAm | 1329 | 1667.94 | 834.97 | 835.55 |
| 607 | Ac-LTF$r8HYWAQL$S-NHnPr3Ph | 1330 | 1715.94 | 858.97 | 859.79 |
| 608 | Ac-LTF$r8HYWAQL$S-NHnBu3,3Me | 1331 | 1681.96 | 841.98 | 842.49 |
| 610 | Ac-LTF$r8HYWAQL$S-NHnPr | 1332 | 1639.91 | 820.96 | 821.58 |
| 611 | Ac-LTF$r8HYWAQL$S-NHnEt2Ch | 1333 | 1707.98 | 854.99 | 855.35 |
| 612 | Ac-LTF$r8HYWAQL$S-NHHex | 1334 | 1681.96 | 841.98 | 842.4 |
| 613 | Ac-LTF$r8AYWAQL$S-NHmdPeg2 | 1335 | 1633.91 | 817.96 | 818.35 |
| 614 | Ac-LTF$r8AYWAQL$A-NHmdPeg2 | 1336 | 1617.92 | 809.96 | 810.3 |
| 615 | Ac-LTF$r8AYWAQL$A-NHmdPeg4 | 1337 | 1705.97 | 853.99 | 854.33 |
| 616 | Ac-F$r8AYdl4mWEAL$A-NH2 | 1338 | 1316.72 | 659.36 | 659.44 |
| 617 | Ac-F$r8AYdl5clWEAL$A-NH2 | 1339 | 1336.66 | 669.33 | 669.43 |
| 618 | Ac-LThF$r8AYWAQL$S-NH2 | 1340 | 1545.86 | 773.93 | 774.11 |
| 619 | Ac-LT2Nal$r8AYWAQL$S-NH2 | 1341 | 1581.86 | 791.93 | 792.43 |
| 620 | Ac-LTA$r8AYWAQL$S-NH2 | 1342 | 1455.81 | 728.91 | 729.15 |
| 621 | Ac-LTF$r8AYWVQL$S-NH2 | 1343 | 1559.88 | 780.94 | 781.24 |
| 622 | Ac-LTF$r8HYWAAL$A-NH2 | 1344 | 1524.85 | 763.43 | 763.86 |
| 623 | Ac-LTF$r8VYWAQL$A-NH2 | 1345 | 1543.88 | 772.94 | 773.37 |
| 624 | Ac-LTF$r8IYWAQL$S-NH2 | 1346 | 1573.89 | 787.95 | 788.17 |
| 625 | Ac-FTF$r8VYWSQL$S-NH2 | 1347 | 1609.85 | 805.93 | 806.22 |
| 626 | Ac-ITF$r8FYWAQL$S-NH2 | 1348 | 1607.88 | 804.94 | 805.2 |
| 627 | Ac-2NalTF$r8VYWSQL$S-NH2 | 1349 | 1659.87 | 830.94 | 831.2 |
| 628 | Ac-ITF$r8LYWSQL$S-NH2 | 1350 | 1589.89 | 795.95 | 796.13 |
| 629 | Ac-FTF$r8FYWAQL$S-NH2 | 1351 | 1641.86 | 821.93 | 822.13 |
| 630 | Ac-WTF$r8VYWAQL$S-NH2 | 1352 | 1632.87 | 817.44 | 817.69 |
| 631 | Ac-WTF$r8WYWAQL$S-NH2 | 1353 | 1719.88 | 860.94 | 861.36 |
| 632 | Ac-VTF$r8AYWSQL$S-NH2 | 1354 | 1533.82 | 767.91 | 768.19 |

TABLE 2B-continued

| Number | Sequence | SEQ ID NO: | Exact Mass | M + 2 | Observed mass (m/e) |
|---|---|---|---|---|---|
| 633 | Ac-WTF$r8FYWSQL$S-NH2 | 1355 | 1696.87 | 849.44 | 849.7 |
| 634 | Ac-FTF$r8IYWAQL$S-NH2 | 1356 | 1607.88 | 804.94 | 805.2 |
| 635 | Ac-WTF$r8VYWSQL$S-NH2 | 1357 | 1648.87 | 825.44 | 824.8 |
| 636 | Ac-FTF$r8LYWSQL$S-NH2 | 1358 | 1623.87 | 812.94 | 812.8 |
| 637 | Ac-YTF$r8FYWSQL$S-NH2 | 1359 | 1673.85 | 837.93 | 837.8 |
| 638 | Ac-LTF$r8AY6clWEAL$A-NH2 | 1360 | 1550.79 | 776.40 | 776.14 |
| 639 | Ac-LTF$r8AY6clWSQL$S-NH2 | 1361 | 1581.80 | 791.90 | 791.68 |
| 640 | Ac-F$r8AY6clWSAL$A-NH2 | 1362 | 1294.65 | 648.33 | 647.67 |
| 641 | Ac-F$r8AY6clWQAL$AA-NH2 | 1363 | 1406.72 | 704.36 | 703.84 |
| 642 | Ac-LHF$r8AYWAQL$S-NH2 | 1364 | 1567.86 | 784.93 | 785.21 |
| 643 | Ac-LTF$r8AYWAQL$S-NH2 | 1365 | 1531.84 | 766.92 | 767.17 |
| 644 | Ac-LTF$r8AHWAQL$S-NH2 | 1366 | 1505.84 | 753.92 | 754.13 |
| 645 | Ac-LTF$r8AYWAHL$S-NH2 | 1367 | 1540.84 | 771.42 | 771.61 |
| 646 | Ac-LTF$r8AYWAQL$H-NH2 | 1368 | 1581.87 | 791.94 | 792.15 |
| 647 | H-LTF$r8AYWAQL$A-NH2 | 1369 | 1473.84 | 737.92 | 737.29 |
| 648 | Ac-HHF$r8AYWAQL$S-NH2 | 1370 | 1591.83 | 796.92 | 797.35 |
| 649 | Ac-aAibWTF$r8VYWSQL$S-NH2 | 1371 | 1804.96 | 903.48 | 903.64 |
| 650 | Ac-AibWTF$r8HYWAQL$S-NH2 | 1372 | 1755.91 | 878.96 | 879.4 |
| 651 | Ac-AibAWTF$r8HYWAQL$S-NH2 | 1373 | 1826.95 | 914.48 | 914.7 |
| 652 | Ac-fWTF$r8HYWAQL$S-NH2 | 1374 | 1817.93 | 909.97 | 910.1 |
| 653 | Ac-AibWWTF$r8HYWAQL$S-NH2 | 1375 | 1941.99 | 972.00 | 972.2 |
| 654 | Ac-WTF$r8LYWSQL$S-NH2 | 1376 | 1662.88 | 832.44 | 832.8 |
| 655 | Ac-WTF$r8NleYWSQL$S-NH2 | 1377 | 1662.88 | 832.44 | 832.6 |
| 656 | Ac-LTF$r8AYWSQL$a-NH2 | 1378 | 1531.84 | 766.92 | 767.2 |
| 657 | Ac-LTF$r8EYWARL$A-NH2 | 1379 | 1601.90 | 801.95 | 802.1 |
| 658 | Ac-LTF$r8EYWAHL$A-NH2 | 1380 | 1582.86 | 792.43 | 792.6 |
| 659 | Ac-aTF$r8AYWAQL$S-NH2 | 1381 | 1489.80 | 745.90 | 746.08 |
| 660 | Ac-AibTF$r8AYWAQL$S-NH2 | 1382 | 1503.81 | 752.91 | 753.11 |
| 661 | Ac-AmfTF$r8AYWAQL$S-NH2 | 1383 | 1579.84 | 790.92 | 791.14 |
| 662 | Ac-AmwTF$r8AYWAQL$S-NH2 | 1384 | 1618.86 | 810.43 | 810.66 |
| 663 | Ac-NmLTF$r8AYWAQL$S-NH2 | 1385 | 1545.86 | 773.93 | 774.11 |
| 664 | Ac-LNmTF$r8AYWAQL$S-NH2 | 1386 | 1545.86 | 773.93 | 774.11 |
| 665 | Ac-LSarF$r8AYWAQL$S-NH2 | 1387 | 1501.83 | 751.92 | 752.18 |
| 667 | Ac-LGF$r8AYWAQL$S-NH2 | 1388 | 1487.82 | 744.91 | 745.15 |
| 668 | Ac-LTNmF$r8AYWAQL$S-NH2 | 1389 | 1545.86 | 773.93 | 774.2 |
| 669 | Ac-TF$r8AYWAQL$S-NH2 | 1390 | 1418.76 | 710.38 | 710.64 |
| 670 | Ac-ETF$r8AYWAQL$A-NH2 | 1391 | 1531.81 | 766.91 | 767.2 |
| 671 | Ac-LTF$r8EYWAQL$A-NH2 | 1392 | 1573.85 | 787.93 | 788.1 |

TABLE 2B-continued

| Number | Sequence | SEQ ID NO: | Exact Mass | M + 2 | Observed mass (m/e) |
|---|---|---|---|---|---|
| 672 | Ac-LT2Nal$r8AYWSQL$S-NH2 | 1393 | 1597.85 | 799.93 | 800.4 |
| 673 | Ac-LTF$r8AYWAAL$S-NH2 | 1394 | 1474.82 | 738.41 | 738.68 |
| 674 | Ac-LTF$r8AYWAQhCha$S-NH2 | 1395 | 1585.89 | 793.95 | 794.19 |
| 675 | Ac-LTF$r8AYWAQChg$S-NH2 | 1396 | 1557.86 | 779.93 | 780.97 |
| 676 | Ac-LTF$r8AYWAQCba$S-NH2 | 1397 | 1543.84 | 772.92 | 773.19 |
| 677 | Ac-LTF$r8AYWAQF3CF3$S-NH2 | 1398 | 1633.82 | 817.91 | 818.15 |
| 678 | Ac-LTF$r8AYWAQ1Nal$S-NH2 | 1399 | 1615.84 | 808.92 | 809.18 |
| 679 | Ac-LTF$r8AYWAQBip$S-NH2 | 1400 | 1641.86 | 821.93 | 822.32 |
| 680 | Ac-LT2Nal$r8AYWAQL$S-NH2 | 1401 | 1581.86 | 791.93 | 792.15 |
| 681 | Ac-LTF$r8AYWVQL$S-NH2 | 1402 | 1559.88 | 780.94 | 781.62 |
| 682 | Ac-LTF$r8AWWAQL$S-NH2 | 1403 | 1554.86 | 778.43 | 778.65 |
| 683 | Ac-FTF$r8VYWSQL$S-NH2 | 1404 | 1609.85 | 805.93 | 806.12 |
| 684 | Ac-ITF$r8FYWAQL$S-NH2 | 1405 | 1607.88 | 804.94 | 805.2 |
| 685 | Ac-ITF$r8LYWSQL$S-NH2 | 1406 | 1589.89 | 795.95 | 796.22 |
| 686 | Ac-FTF$r8FYWAQL$S-NH2 | 1407 | 1641.86 | 821.93 | 822.41 |
| 687 | Ac-VTF$r8AYWSQL$S-NH2 | 1408 | 1533.82 | 767.91 | 768.19 |
| 688 | Ac-LTF$r8AHWAQL$S-NH2 | 1409 | 1505.84 | 753.92 | 754.31 |
| 689 | Ac-LTF$r8AYWAQL$H-NH2 | 1410 | 1581.87 | 791.94 | 791.94 |
| 690 | Ac-LTF$r8AYWAHL$S-NH2 | 1411 | 1540.84 | 771.42 | 771.61 |
| 691 | Ac-aAibWTF$r8VYWSQL$S-NH2 | 1412 | 1804.96 | 903.48 | 903.9 |
| 692 | Ac-AibWTF$r8HYWAQL$S-NH2 | 1413 | 1755.91 | 878.96 | 879.5 |
| 693 | Ac-AibAWTF$r8HYWAQL$S-NH2 | 1414 | 1826.95 | 914.48 | 914.7 |
| 694 | Ac-fWTF$r8HYWAQL$S-NH2 | 1415 | 1817.93 | 909.97 | 910.2 |
| 695 | Ac-AibWWTF$r8HYWAQL$S-NH2 | 1416 | 1941.99 | 972.00 | 972.7 |
| 696 | Ac-WTF$r8LYWSQL$S-NH2 | 1417 | 1662.88 | 832.44 | 832.7 |
| 697 | Ac-WTF$r8NleYWSQL$S-NH2 | 1418 | 1662.88 | 832.44 | 832.7 |
| 698 | Ac-LTF$r8AYWSQL$a-NH2 | 1419 | 1531.84 | 766.92 | 767.2 |
| 699 | Ac-LTF$r8EYWARL$A-NH2 | 1420 | 1601.90 | 801.95 | 802.2 |
| 700 | Ac-LTF$r8EYWAHL$A-NH2 | 1421 | 1582.86 | 792.43 | 792.6 |
| 701 | Ac-aTF$r8AYWAQL$S-NH2 | 1422 | 1489.80 | 745.90 | 746.1 |
| 702 | Ac-AibTF$r8AYWAQL$S-NH2 | 1423 | 1503.81 | 752.91 | 753.2 |
| 703 | Ac-AmfTF$r8AYWAQL$S-NH2 | 1424 | 1579.84 | 790.92 | 791.2 |
| 704 | Ac-AmwTF$r8AYWAQL$S-NH2 | 1425 | 1618.86 | 810.43 | 810.7 |
| 705 | Ac-NmLTF$r8AYWAQL$S-NH2 | 1426 | 1545.86 | 773.93 | 774.1 |
| 706 | Ac-LNmTF$r8AYWAQL$S-NH2 | 1427 | 1545.86 | 773.93 | 774.4 |
| 707 | Ac-LSarF$r8AYWAQL$S-NH2 | 1428 | 1501.83 | 751.92 | 752.1 |
| 708 | Ac-TF$r8AYWAQL$S-NH2 | 1429 | 1418.76 | 710.38 | 710.8 |
| 709 | Ac-ETF$r8AYWAQL$A-NH2 | 1430 | 1531.81 | 766.91 | 767.4 |

TABLE 2B-continued

| Number | Sequence | SEQ ID NO: | Exact Mass | M + 2 | Observed mass (m/e) |
|---|---|---|---|---|---|
| 710 | Ac-LTF$r8EYWAQL$A-NH2 | 1431 | 1573.85 | 787.93 | 788.2 |
| 711 | Ac-WTF$r8VYWSQL$S-NH2 | 1432 | 1648.87 | 825.44 | 825.2 |
| 713 | Ac-YTF$r8FYWSQL$S-NH2 | 1433 | 1673.85 | 837.93 | 837.3 |
| 714 | Ac-F$r8AY6clWSAL$A-NH2 | 1434 | 1294.65 | 648.33 | 647.74 |
| 715 | Ac-ETF$r8EYWVQL$S-NH2 | 1435 | 1633.84 | 817.92 | 817.36 |
| 716 | Ac-ETF$r8EHWAQL$A-NH2 | 1436 | 1563.81 | 782.91 | 782.36 |
| 717 | Ac-ITF$r8EYWAQL$S-NH2 | 1437 | 1589.85 | 795.93 | 795.38 |
| 718 | Ac-ITF$r8EHWVQL$A-NH2 | 1438 | 1575.88 | 788.94 | 788.42 |
| 719 | Ac-ITF$r8EHWAQL$S-NH2 | 1439 | 1563.85 | 782.93 | 782.43 |
| 720 | Ac-LTF4F$r8AYWAQCba$S-NH2 | 1440 | 1561.83 | 781.92 | 781.32 |
| 721 | Ac-LTF3Cl$r8AYWAQhL$S-NH2 | 1441 | 1579.82 | 790.91 | 790.64 |
| 722 | Ac-LTF3Cl$r8AYWAQCha$S-NH2 | 1442 | 1605.84 | 803.92 | 803.37 |
| 723 | Ac-LTF3Cl$r8AYWAQChg$S-NH2 | 1443 | 1591.82 | 796.91 | 796.27 |
| 724 | Ac-LTF3Cl$r8AYWAQCba$S-NH2 | 1444 | 1577.81 | 789.91 | 789.83 |
| 725 | Ac-LTF$r8AY6clWSQL$S-NH2 | 1445 | 1581.80 | 791.90 | 791.75 |
| 726 | Ac-LTF4F$r8HYWAQhL$S-NH2 | 1446 | 1629.87 | 815.94 | 815.36 |
| 727 | Ac-LTF4F$r8HYWAQCba$S-NH2 | 1447 | 1627.86 | 814.93 | 814.32 |
| 728 | Ac-LTF4F$r8AYWAQhL$S-NH2 | 1448 | 1563.85 | 782.93 | 782.36 |
| 729 | Ac-LTF4F$r8AYWAQChg$S-NH2 | 1449 | 1575.85 | 788.93 | 788.35 |
| 730 | Ac-ETF$r8EYWVAL$S-NH2 | 1450 | 1576.82 | 789.41 | 788.79 |
| 731 | Ac-ETF$r8EHWAAL$A-NH2 | 1451 | 1506.79 | 754.40 | 754.8 |
| 732 | Ac-ITF$r8EYWAAL$S-NH2 | 1452 | 1532.83 | 767.42 | 767.75 |
| 733 | Ac-ITF$r8EHWVAL$A-NH2 | 1453 | 1518.86 | 760.43 | 760.81 |
| 734 | Ac-ITF$r8EHWAAL$S-NH2 | 1454 | 1506.82 | 754.41 | 754.8 |
| 735 | Pam-LTF$r8EYWAQL$S-NH2 | 1455 | 1786.07 | 894.04 | 894.48 |
| 736 | Pam-ETF$r8EYWAQL$S-NH2 | 1456 | 1802.03 | 902.02 | 902.34 |
| 737 | Ac-LTF$r8AYWLQL$S-NH2 | 1457 | 1573.89 | 787.95 | 787.39 |
| 738 | Ac-LTF$r8EYWLQL$S-NH2 | 1458 | 1631.90 | 816.95 | 817.33 |
| 739 | Ac-LTF$r8EHWLQL$S-NH2 | 1459 | 1605.89 | 803.95 | 804.29 |
| 740 | Ac-LTF$r8VYWAQL$S-NH2 | 1460 | 1559.88 | 780.94 | 781.34 |
| 741 | Ac-LTF$r8AYWSQL$S-NH2 | 1461 | 1547.84 | 774.92 | 775.33 |
| 742 | Ac-ETF$r8AYWAQL$S-NH2 | 1462 | 1547.80 | 774.90 | 775.7 |
| 743 | Ac-LTF$r8EYWAQL$S-NH2 | 1463 | 1589.85 | 795.93 | 796.33 |
| 744 | Ac-LTF$r8HYWAQL$S-NHAm | 1464 | 1667.94 | 834.97 | 835.37 |
| 745 | Ac-LTF$r8HYWAQL$S-NHiAm | 1465 | 1667.94 | 834.97 | 835.27 |
| 746 | Ac-LTF$r8HYWAQL$S-NHnPr3Ph | 1466 | 1715.94 | 858.97 | 859.42 |
| 747 | Ac-LTF$r8HYWAQL$S-NHnBu3,3Me | 1467 | 1681.96 | 841.98 | 842.67 |
| 748 | Ac-LTF$r8HYWAQL$S-NHnBu | 1468 | 1653.93 | 827.97 | 828.24 |

TABLE 2B-continued

| Number | Sequence | SEQ ID NO: | Exact Mass | M + 2 | Observed mass (m/e) |
|---|---|---|---|---|---|
| 749 | Ac-LTF$r8HYWAQL$S-NHnPr | 1469 | 1639.91 | 820.96 | 821.31 |
| 750 | Ac-LTF$r8HYWAQL$S-NHnEt2Ch | 1470 | 1707.98 | 854.99 | 855.35 |
| 751 | Ac-LTF$r8HYWAQL$S-NHHex | 1471 | 1681.96 | 841.98 | 842.4 |
| 752 | Ac-LTF$r8AYWAQL$S-NHmdPeg2 | 1472 | 1633.91 | 817.96 | 855.35 |
| 753 | Ac-LTF$r8AYWAQL$A-NHmdPeg2 | 1473 | 1617.92 | 809.96 | 810.58 |
| 754 | Ac-LTF$r5AYWAALSs8S-NH2 | 1474 | 1474.82 | 738.41 | 738.79 |
| 755 | Ac-LTF$r8AYWCouQL$S-NH2 | 1475 | 1705.88 | 853.94 | 854.61 |
| 756 | Ac-LTF$r8CouYWAQL$S-NH2 | 1476 | 1705.88 | 853.94 | 854.7 |
| 757 | Ac-CouTF$r8AYWAQL$S-NH2 | 1477 | 1663.83 | 832.92 | 833.33 |
| 758 | H-LTF$r8AYWAQL$A-NH2 | 1478 | 1473.84 | 737.92 | 737.29 |
| 759 | Ac-HHF$r8AYWAQL$S-NH2 | 1479 | 1591.83 | 796.92 | 797.72 |
| 760 | Ac-LT2Nal$r8AYWSQL$S-NH2 | 1480 | 1597.85 | 799.93 | 800.68 |
| 761 | Ac-LTF$r8HCouWAQL$S-NH2 | 1481 | 1679.87 | 840.94 | 841.38 |
| 762 | Ac-LTF$r8AYWCou2QL$S-NH2 | 1482 | 1789.94 | 895.97 | 896.51 |
| 763 | Ac-LTF$r8Cou2YWAQL$S-NH2 | 1483 | 1789.94 | 895.97 | 896.5 |
| 764 | Ac-Cou2TF$r8AYWAQL$S-NH2 | 1484 | 1747.90 | 874.95 | 875.42 |
| 765 | Ac-LTF$r8ACou2WAQL$S-NH2 | 1485 | 1697.92 | 849.96 | 850.82 |
| 766 | Dmaac-LTF$r8AYWAQL$S-NH2 | 1486 | 1574.89 | 788.45 | 788.82 |
| 767 | Hexac-LTF$r8AYWAQL$S-NH2 | 1487 | 1587.91 | 794.96 | 795.11 |
| 768 | Napac-LTF$r8AYWAQL$S-NH2 | 1488 | 1657.89 | 829.95 | 830.36 |
| 769 | Pam-LTF$r8AYWAQL$S-NH2 | 1489 | 1728.06 | 865.03 | 865.45 |
| 770 | Ac-LT2Nal$r8HYAAQL$S-NH2 | 1490 | 1532.84 | 767.42 | 767.61 |
| 771 | Ac-LT2Nal$/r8HYWAQL$/S-NH2 | 1491 | 1675.91 | 838.96 | 839.1 |
| 772 | Ac-LT2Nal$r8HYFAQL$S-NH2 | 1492 | 1608.87 | 805.44 | 805.9 |
| 773 | Ac-LT2Nal$r8HWAAQL$S-NH2 | 1493 | 1555.86 | 778.93 | 779.08 |
| 774 | Ac-LT2Nal$r8HYAWQL$S-NH2 | 1494 | 1647.88 | 824.94 | 825.04 |
| 775 | Ac-LT2Nal$r8HYAAQW$S-NH2 | 1495 | 1605.83 | 803.92 | 804.05 |
| 776 | Ac-LTW$r8HYWAQL$S-NH2 | 1496 | 1636.88 | 819.44 | 819.95 |
| 777 | Ac-LT1Nal$r8HYWAQL$S-NH2 | 1497 | 1647.88 | 824.94 | 825.41 |
| 778 | Ac-F$r8ApmpEt6clWEAL$A-NH2 | 1502 | 1470.71 | 736.36 | 788.17 |

In some embodiments, the peptidomimetic macrocycles disclosed herein do not comprise a peptidomimetic macrocycle structure as shown in Table 2b.

Table 2c shows examples of non-crosslinked polypeptides comprising D-amino acids.

| SP | Sequence | SEQ ID NO: | Isomer | Exact Mass | Found Mass | Calc (M + 1)/1 | Calc (M + 2)/2 | Calc (M + 3)/3 |
|---|---|---|---|---|---|---|---|---|
| SP765 | Ac-tawyanfekllr-NH2 | 1498 | | | 777.46 | | | |
| SP766 | Ac-tawyanf4CF3ekllr-NH2 | 1499 | | | 811.41 | | | |

Example 3

X-Ray Co-Crystallography of Peptidomimetic Macrocycles in Complex with MDMX For co-crystallization with peptide 46 (Table 2b), a stoichiometric amount of compound from a 100 mM stock solution in DMSO was added to the zebrafish MDMX protein solution and allowed to sit overnight at 4° C. before setting up crystallization experiments. Procedures were similar to those described by Popowicz et al. with some variations, as noted below. Protein (residues 15-129, L46V/V95L) was obtained from an E. coli BL21(DE3) expression system using the pET15b vector. Cells were grown at 37° C. and induced with 1 mM IPTG at an $OD_{600}$ of 0.7. Cells were allowed to grow an additional 18 hr at 23° C. Protein was purified using Ni-NT Agarose followed by Superdex 75 buffered with 50 mM $NaPO_4$, pH 8.0, 150 mM NaCl, 2 mM TCEP and then concentrated to 24 mg/ml. The buffer was exchanged to 20 mM Tris, pH 8.0, 50 mM NaCl, 2 mM DTT for crystallization experiments. Initial crystals were obtained with the Nextal (Qiagen) AMS screen #94 and the final optimized reservoir was 2.6 M AMS, 75 mM Hepes, pH 7.5. Crystals grew routinely as thin plates at 4° C. and were cryo-protected by pulling them through a solution containing concentrated (3.4 M) malonate followed by flash cooling, storage, and shipment in liquid nitrogen.

Data collection was performed at the APS at beamline 31-ID (SGX-CAT) at 100° K and wavelength 0.97929 Å. The beamline was equipped with a Rayonix 225-HE detector. For data collection, crystals were rotated through 180° in 1° increments using 0.8 second exposure times. Data were processed and reduced using Mosflm/scala (CCP4; see The CCP4 Suite: Programs for Protein Crystallography. Acta Crystallogr. D50, 760-763 (1994); P. R. Evans. Joint CCP4 and ESF-EACBM Newsletter 33, 22-24 (1997)) in space group C2 (unit cell: a=109.2786, b=81.0836, c=30.9058 Å, α=90, β=89.8577, γ=90°). Molecular replacement with program Molrep (CCP4; see A. Vagin & A. Teplyakov. J. Appl. Cryst. 30, 1022-1025 (1997)) was performed with the MDMX component of the structure determined by Popowicz et al. (2Z5S; see G. M. Popowicz, A. Czarna, U. Rothweiler, A. Szwagierczak, M. Krajewski, L. Weber & T. A. Holak. Cell Cycle 6, 2386-2392 (2007)) and identified two molecules in the asymmetric unit. Initial refinement of just the two molecules of the zebrafish MDMX with program Refmac (CCP4; see G. N. Murshudov, A. A. Vagin & E. J. Dodson. Acta Crystallogr. D53, 240-255 (1997)) resulted in an R-factor of 0.3424 ($R_{free}$=0.3712) and rmsd values for bonds (0.018 Å) and angles (1.698°). The electron density for the stapled peptide components, starting with $Gln^{19}$ and including all of the aliphatic staple, was very clear. Further refinement with CNX (Accelrys) using data to 2.3 Å resolution resulted in a model (comprised of 1448 atoms from MDMX, 272 atoms from the stapled peptides and 46 water molecules) that is well refined ($R_f$=0.2601, $R_{free}$=0.3162, rmsd bonds=0.007 Å and rmsd angles=0.916°).

Figure 2:
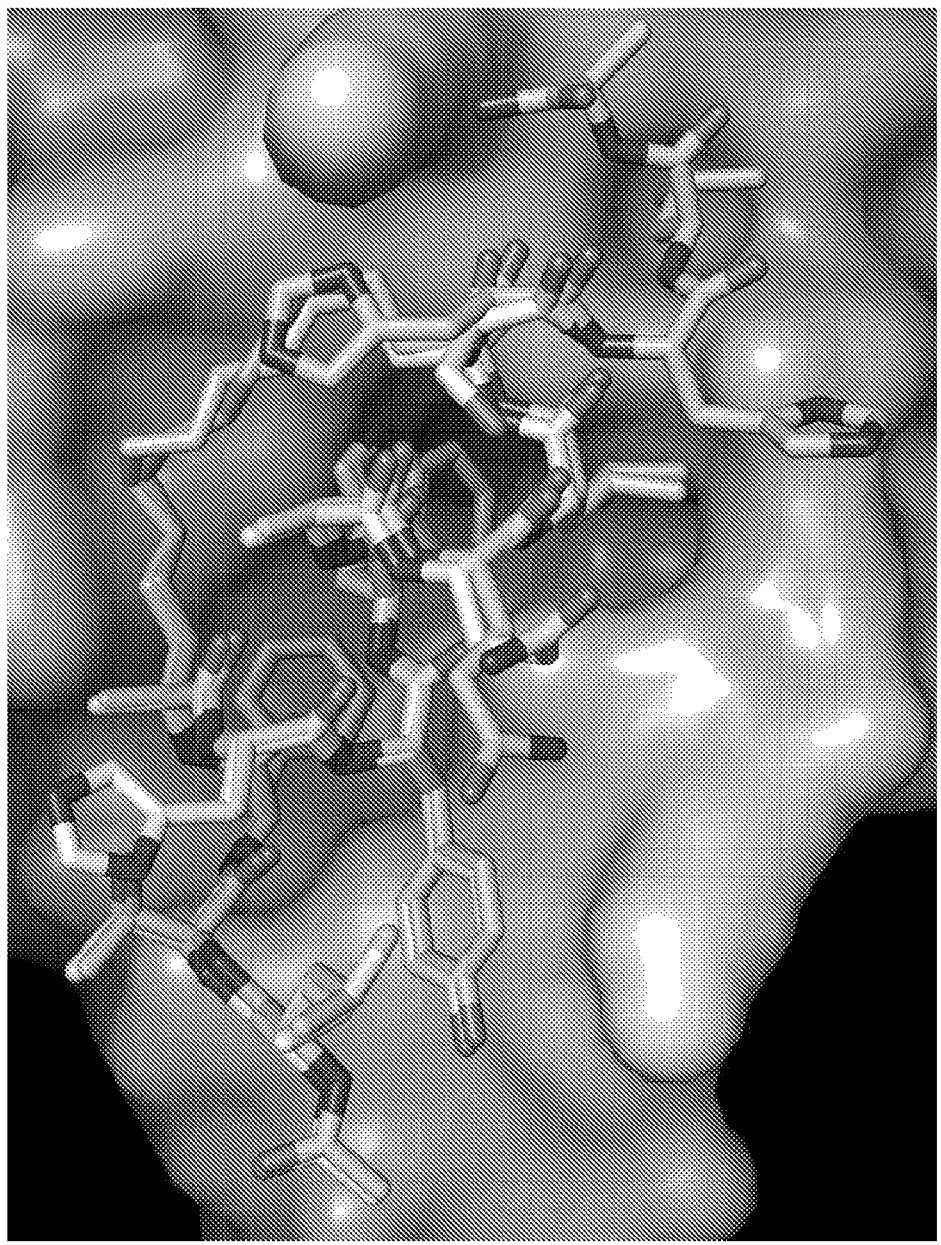
FIG. 2 shows overlaid structures of p53 peptidomimetic macrocycles 142 (Table 2b) and SP43 bound to MDMX (Primary SwissProt accession number Q7ZUW7; Entry MDM4_DANRE).
Figure 3:
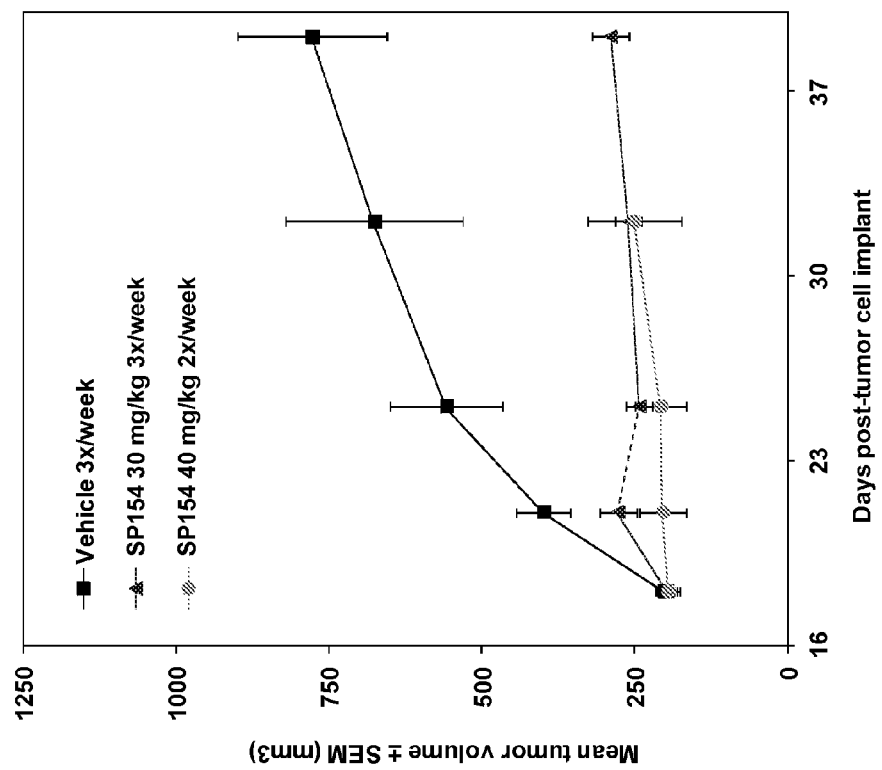
FIG. 3 shows the effect of SP154, a peptidomimetic macrocycle, on tumor growth in a mouse MCF-7 xenograft model.
Figure 4:
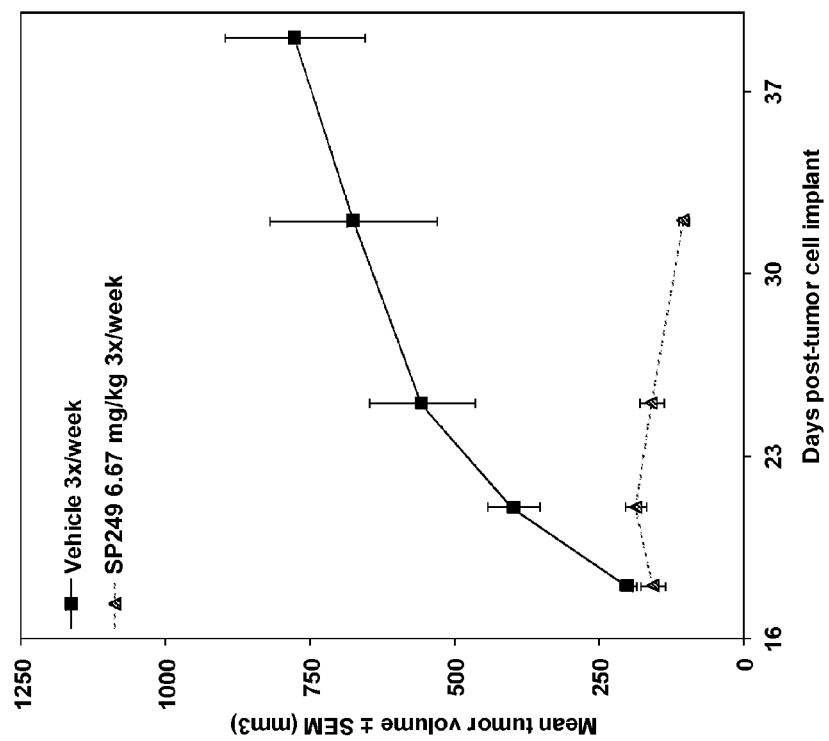
FIG. 4 shows the effect of SP249, a peptidomimetic macrocycle, on tumor growth in a mouse MCF-7 xenograft model.
Figure 5:
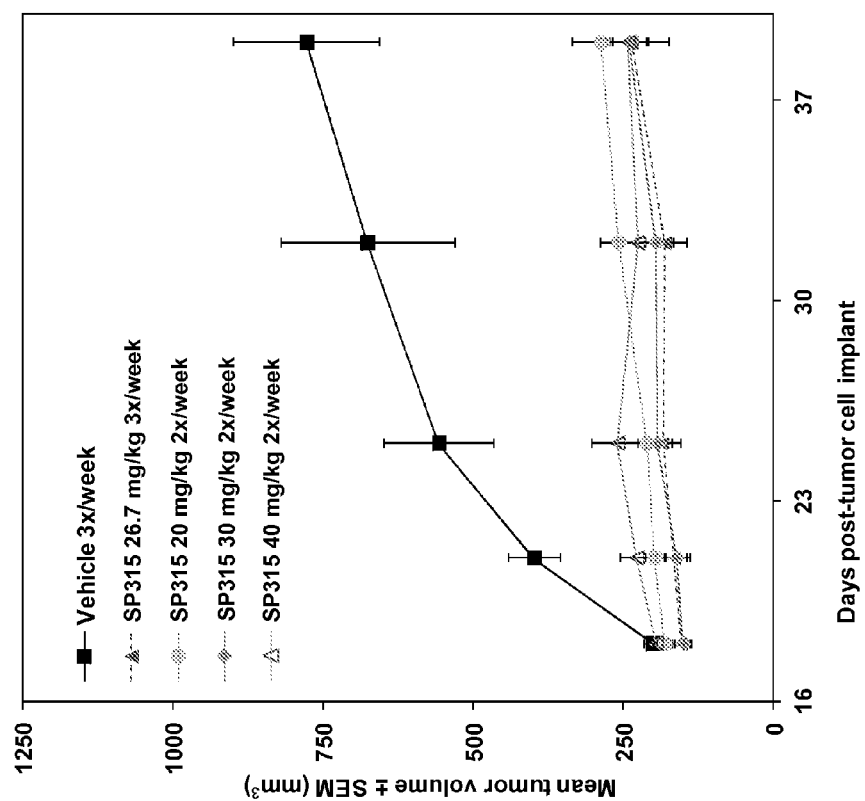
FIG. 5 shows the effect of SP315, a peptidomimetic macrocycle, on tumor growth in a mouse MCF-7 xenograft model.
Figure 6:
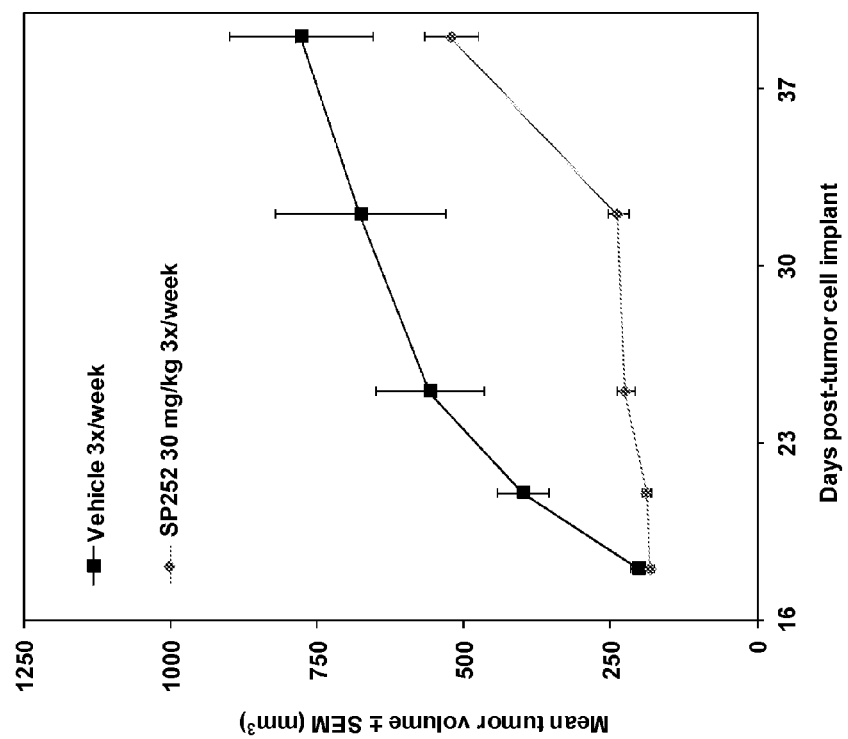
FIG. 6 shows the effect of SP252, a point mutation of SP154, on tumor growth in a mouse MCF-7 xenograft model.

Results from this Example are shown in FIGS. 1 and 2.

Example 4

Circular Dichroism (CD) Analysis of Alpha-Helicity

Peptide solutions were analyzed by CD spectroscopy using a Jasco J-815 spectropolarimeter (Jasco Inc., Easton, Md.) with the Jasco Spectra Manager Ver.2 system software. A Peltier temperature controller was used to maintain temperature control of the optical cell. Results are expressed as mean molar ellipticity [θ] (deg cm2 dmol-1) as calculated from the equation [θ]=θobs.MRW/10*l*c where θobs is the observed ellipticity in millidegrees, MRW is the mean residue weight of the peptide (peptide molecular weight/number of residues), l is the optical path length of the cell in centimeters, and c is the peptide concentration in mg/ml. Peptide concentrations were determined by amino acid analysis. Stock solutions of peptides were prepared in benign CD buffer (20 mM phosphoric acid, pH 2). The stocks were used to prepare peptide solutions of 0.05 mg/ml in either benign CD buffer or CD buffer with 50% trifluoroethanol (TFE) for analyses in a 10 mm pathlength cell. Variable wavelength measurements of peptide solutions were scanned at 4° C. from 195 to 250 nm, in 0.2 nm increments, and a scan rate 50 nm per minute. The average of six scans was reported.

Table 3 shows circular dichroism data for selected peptiomimetic macrocycles:

TABLE 3

| SP# | Molar Ellipticity Benign (222 in 0% TFE) | Molar Ellipticity 50% TFE (222 in 50% TFE) | Molar Ellipticity TFE - Molar Ellipticity Benign | % Helix 50% TFE compared to 50% TFE parent (CD) | % Helix benign compared to 50% TFE parent (CD) |
|---|---|---|---|---|---|
| 7 | 124 | −19921.4 | −20045.4 | 137.3 | −0.9 |
| 11 | −398.2 | −16623.4 | 16225.2 | 106.1 | 2.5 |
| 41 | −909 | −21319.4 | 20410.4 | 136 | 5.8 |
| 43 | −15334.5 | −18247.4 | 2912.9 | 116.4 | 97.8 |
| 69 | −102.6 | −21509.7 | −21407.1 | 148.2 | 0.7 |
| 71 | −121.2 | −17957 | −17835.9 | 123.7 | 0.8 |
| 154 | −916.2 | −30965.1 | −30048.9 | 213.4 | 6.3 |
| 230 | −213.2 | −17974 | −17760.8 | 123.9 | 1.5 |
| 233 | −477.9 | −19032.6 | −18554.7 | 131.2 | 3.3 |

Example 5

Direct Binding Assay MDM2 with Fluorescence Polarization (FP)

The assay was performed according to the following general protocol:

1. Dilute MDM2 (In-house, 41 kD) into FP buffer (High salt buffer-200 mM Nacl, 5 mM CHAPS, pH 7.5) to make 10 μM working stock solution.
2. Add 30 μM of 10 μM of protein stock solution into A1 and B1 well of 96-well black HE microplate (Molecular Devices).
3. Fill in 30 μl of FP buffer into column A2 to A12, B2 to B12, C1 to C12, and D1 to D12.
4. 2 or 3 fold series dilution of protein stock from A1, B1 into A2, B2; A2, B2 to A3, B3; . . . to reach the single digit nM concentration at the last dilution point.
5. Dilute 1 mM (in 100% DMSO) of FAM labeled linear peptide with DMSO to 100 μM (dilution 1:10). Then, dilute from 100 μM to 10 μM with water (dilution 1:10) and then dilute with FP buffer from 10 μM to 40 nM (dilution 1:250). This is the working solution which will be a 10 nM concentration in well (dilution 1:4). Keep the diluted FAM labeled peptide in the dark until use.

6. Add 10 µl of 10 nM of FAM labeled peptide into each well and incubate, and read at different time points. Kd with 5-FAM-BaLTFEHYWAQLTS-NH$_2$ (SEQ ID NO: 943) is ~13.38 nM.

Example 6

Competitive Fluorescence Polarization Assay for MDM2

The assay was performed according to the following general protocol:
1. Dilute MDM2 (In-house, 41 kD) into FP buffer (High salt buffer-200 mM Nacl, 5 mM CHAPS, pH 7.5) to make 84 nM (2x) working stock solution.
2. Add 20 µM of 84 nM (2x) of protein stock solution into each well of 96-well black HE microplate (Molecular Devices)
3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
4. Make unlabeled peptide dose plate with FP buffer starting with 1 µM (final) of peptide and making 5 fold serial dilutions for 6 points using following dilution scheme.
Dilute 10 mM (in 100% DMSO) with DMSO to 5 mM (dilution 1:2). Then, dilute from 5 mM to 500 µM with H$_2$O (dilution 1:10) and then dilute with FP buffer from 500 µM to 20 µM (dilution 1:25). Making 5 fold serial dilutions from 4 µM (4x) for 6 points.
5. Transfer 10 µM of serial diluted unlabeled peptides to each well which is filled with 20 µM of 84 nM of protein.
6. Add 10 µM of 10 nM (4x) of FAM labeled peptide into each well and incubate for 3 hr to read.

Example 7

Direct Binding Assay MDMX with Fluorescence Polarization (FP)

The assay was performed according to the following general protocol:
1. Dilute MDMX (In-house, 40 kD) into FP buffer (High salt buffer-200 mM Nacl, 5 mM CHAPS, pH 7.5) to make 10 mM working stock solution.
2. Add 30 µM of 10 mM of protein stock solution into A1 and B1 well of 96-well black HE microplate (Molecular Devices).
3. Fill in 30 µM of FP buffer into column A2 to A12, B2 to B12, C1 to C12, and D1 to D12.
4. 2 or 3 fold series dilution of protein stock from A1, B1 into A2, B2; A2, B2 to A3, B3; . . . to reach the single digit nM concentration at the last dilution point.
5. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
6. Add 10 µM of 10 nM of FAM labeled peptide into each well and incubate, and read at different time points. Kd with 5-FAM-BaLTFEHYWAQLTS-NH$_2$ (SEQ ID NO: 943) is ~51 nM.

Example 8

Competitive Fluorescence Polarization Assay for MDMX

The assay was performed according to the following general protocol:
1. Dilute MDMX (In-house, 40 kD) into FP buffer (High salt buffer-200 mM Nacl, 5 mM CHAPS, pH 7.5.) to make 300 nM (2x) working stock solution.
2. Add 20 µM of 300 nM (2x) of protein stock solution into each well of 96-well black HE microplate (Molecular Devices)
3. Dilute 1 mM (in 100% DMSO) of FAM labeled linear peptide with DMSO to 100 µM (dilution 1:10). Then, dilute from 100 µM to 10 µM with water (dilution 1:10) and then dilute with FP buffer from 10 µM to 40 nM (dilution 1:250). This is the working solution which will be a 10 nM concentration in well (dilution 1:4). Keep the diluted FAM labeled peptide in the dark until use.
4. Make unlabeled peptide dose plate with FP buffer starting with 5 µM (final) of peptide and making 5 fold serial dilutions for 6 points using following dilution scheme.
5. Dilute 10 mM (in 100% DMSO) with DMSO to 5 mM (dilution 1:2). Then, dilute from 5 mM to 500 µM with H$_2$O (dilution 1:10) and then dilute with FP buffer from 500 µM to 20 µM (dilution 1:25). Making 5 fold serial dilutions from 20 µM (4x) for 6 points.
6. Transfer 10 µl of serial diluted unlabeled peptides to each well which is filled with 20 µl of 300 nM of protein.
7. Add 10 µl of 10 nM (4x) of FAM labeled peptide into each well and incubate for 3 hr to read. Results from Examples 5-8 are shown in Table 4. The following scale is used: "+" represents a value greater than 1000 nM, "++" represents a value greater than 100 and less than or equal to 1000 nM, "+++" represents a value greater than 10 nM and less than or equal to 100 nM, and "++++" represents a value of less than or equal to 10 nM.

TABLE 4

| SP# | IC50 (MDM2) | IC50 (MDMX) | Ki (MDM2) | Ki (MDMX) |
|---|---|---|---|---|
| 3 | ++ | ++ | +++ | +++ |
| 4 | +++ | ++ | ++++ | +++ |
| 5 | +++ | ++ | ++++ | +++ |
| 6 | ++ | ++ | +++ | +++ |
| 7 | +++ | +++ | ++++ | +++ |
| 8 | ++ | ++ | +++ | +++ |
| 9 | ++ | ++ | +++ | +++ |
| 10 | ++ | ++ | +++ | +++ |
| 11 | +++ | ++ | ++++ | +++ |
| 12 | + | + | +++ | ++ |
| 13 | ++ | ++ | +++ | ++ |
| 14 | +++ | +++ | ++++ | ++++ |
| 15 | +++ | ++ | +++ | +++ |
| 16 | +++ | +++ | ++++ | +++ |
| 17 | +++ | +++ | ++++ | +++ |
| 18 | +++ | +++ | ++++ | ++++ |
| 19 | ++ | +++ | +++ | +++ |
| 20 | ++ | ++ | +++ | +++ |

TABLE 4-continued

| SP# | IC50 (MDM2) | IC50 (MDMX) | Ki (MDM2) | Ki (MDMX) |
|---|---|---|---|---|
| 21 | ++ | +++ | +++ | +++ |
| 22 | +++ | +++ | ++++ | +++ |
| 23 | ++ | ++ | +++ | +++ |
| 24 | +++ | ++ | ++++ | +++ |
| 26 | +++ | ++ | ++++ | +++ |
| 28 | +++ | +++ | ++++ | +++ |
| 30 | ++ | ++ | +++ | +++ |
| 32 | +++ | ++ | ++++ | +++ |
| 38 | + | ++ | ++ | +++ |
| 39 | + | ++ | ++ | ++ |
| 40 | ++ | ++ | ++ | +++ |
| 41 | ++ | +++ | +++ | +++ |
| 42 | ++ | ++ | +++ | ++ |
| 43 | +++ | +++ | ++++ | +++ |
| 45 | +++ | +++ | ++++ | ++++ |
| 46 | +++ | +++ | ++++ | +++ |
| 47 | ++ | ++ | +++ | +++ |
| 48 | ++ | ++ | +++ | +++ |
| 49 | ++ | ++ | +++ | +++ |
| 50 | +++ | ++ | ++++ | +++ |
| 52 | +++ | +++ | ++++ | ++++ |
| 54 | ++ | ++ | +++ | +++ |
| 55 | + | + | ++ | ++ |
| 65 | +++ | ++ | ++++ | +++ |
| 68 | ++ | ++ | +++ | +++ |
| 69 | +++ | ++ | ++++ | +++ |
| 70 | ++ | ++ | ++++ | +++ |
| 71 | +++ | ++ | ++++ | +++ |
| 75 | +++ | ++ | ++++ | +++ |
| 77 | +++ | ++ | ++++ | +++ |
| 80 | +++ | ++ | ++++ | +++ |
| 81 | ++ | ++ | +++ | +++ |
| 82 | ++ | ++ | +++ | +++ |
| 85 | +++ | ++ | ++++ | +++ |
| 99 | ++++ | ++ | ++++ | +++ |
| 100 | ++ | ++ | ++++ | +++ |
| 101 | +++ | ++ | ++++ | +++ |
| 102 | ++ | ++ | ++++ | +++ |
| 103 | ++ | ++ | ++++ | +++ |
| 104 | +++ | ++ | ++++ | +++ |
| 105 | +++ | ++ | ++++ | +++ |
| 106 | ++ | ++ | +++ | +++ |
| 107 | ++ | ++ | +++ | +++ |
| 108 | +++ | ++ | ++++ | +++ |
| 109 | +++ | ++ | ++++ | +++ |
| 110 | ++ | ++ | ++++ | +++ |
| 111 | ++ | ++ | ++++ | +++ |
| 112 | ++ | ++ | +++ | +++ |
| 113 | ++ | ++ | +++ | +++ |
| 114 | +++ | ++ | ++++ | +++ |
| 115 | ++++ | ++ | ++++ | +++ |
| 116 | + | + | ++ | ++ |
| 118 | ++++ | ++ | ++++ | +++ |
| 120 | +++ | ++ | ++++ | +++ |
| 121 | ++++ | ++ | ++++ | +++ |
| 122 | ++++ | ++ | ++++ | +++ |
| 123 | ++++ | ++ | ++++ | +++ |
| 124 | ++++ | ++ | ++++ | +++ |
| 125 | ++++ | ++ | ++++ | +++ |
| 126 | ++++ | ++ | ++++ | +++ |
| 127 | ++++ | ++ | ++++ | +++ |
| 128 | ++++ | ++ | ++++ | +++ |
| 129 | ++++ | ++ | ++++ | +++ |
| 130 | ++++ | ++ | ++++ | +++ |
| 133 | ++++ | ++ | ++++ | +++ |
| 134 | ++++ | ++ | ++++ | +++ |
| 135 | ++++ | ++ | ++++ | +++ |
| 136 | ++++ | ++ | ++++ | +++ |
| 137 | ++++ | ++ | ++++ | +++ |
| 139 | ++++ | ++ | ++++ | +++ |
| 142 | ++++ | +++ | ++++ | +++ |
| 144 | ++++ | ++ | ++++ | +++ |
| 146 | ++++ | ++ | ++++ | +++ |
| 148 | ++++ | ++ | ++++ | +++ |
| 150 | ++++ | ++ | ++++ | +++ |
| 153 | ++++ | +++ | ++++ | +++ |
| 154 | ++++ | +++ | ++++ | ++++ |
| 156 | ++++ | ++ | ++++ | +++ |
| 158 | ++++ | ++ | ++++ | +++ |
| 160 | ++++ | ++ | ++++ | +++ |
| 161 | ++++ | ++ | ++++ | +++ |
| 166 | ++++ | ++ | ++++ | +++ |
| 167 | +++ | ++ | ++++ | ++ |
| 169 | ++++ | +++ | ++++ | +++ |
| 170 | ++++ | ++ | ++++ | +++ |
| 173 | ++++ | ++ | ++++ | +++ |
| 175 | ++++ | ++ | ++++ | +++ |
| 177 | +++ | ++ | ++++ | +++ |
| 180 | +++ | ++ | ++++ | +++ |
| 182 | ++++ | ++ | ++++ | +++ |
| 185 | +++ | + | ++++ | ++ |
| 186 | +++ | ++ | ++++ | +++ |
| 189 | +++ | ++ | ++++ | +++ |
| 192 | +++ | ++ | ++++ | +++ |
| 194 | +++ | ++ | ++++ | ++ |
| 196 | +++ | ++ | ++++ | +++ |
| 197 | ++++ | ++ | ++++ | +++ |
| 199 | +++ | ++ | ++++ | ++ |
| 201 | +++ | ++ | ++++ | ++ |
| 203 | +++ | ++ | ++++ | +++ |
| 204 | +++ | ++ | ++++ | +++ |
| 206 | +++ | ++ | ++++ | +++ |
| 207 | ++++ | ++ | ++++ | +++ |
| 210 | ++++ | ++ | ++++ | +++ |
| 211 | ++++ | ++ | ++++ | +++ |
| 213 | ++++ | ++ | ++++ | +++ |
| 215 | +++ | ++ | ++++ | +++ |
| 217 | ++++ | ++ | ++++ | +++ |
| 218 | ++++ | ++ | ++++ | +++ |
| 221 | ++++ | +++ | ++++ | +++ |
| 227 | ++++ | ++ | ++++ | +++ |
| 230 | ++++ | +++ | ++++ | ++++ |
| 232 | ++++ | ++ | ++++ | +++ |
| 233 | ++++ | +++ | ++++ | +++ |
| 236 | +++ | ++ | ++++ | +++ |
| 237 | +++ | ++ | ++++ | +++ |
| 238 | +++ | +++ | ++++ | +++ |
| 239 | +++ | ++ | +++ | +++ |
| 240 | +++ | ++ | ++++ | +++ |
| 241 | +++ | ++ | ++++ | +++ |
| 242 | +++ | ++ | ++++ | +++ |
| 243 | +++ | +++ | ++++ | +++ |
| 244 | +++ | +++ | ++++ | ++++ |
| 245 | +++ | +++ | ++++ | +++ |
| 246 | +++ | ++ | ++++ | +++ |
| 247 | +++ | +++ | ++++ | +++ |
| 248 | +++ | +++ | ++++ | +++ |
| 249 | +++ | +++ | ++++ | ++++ |
| 250 | ++ | + | ++ | + |
| 252 | ++ | + | ++ | + |
| 254 | +++ | ++ | ++++ | +++ |
| 255 | +++ | +++ | ++++ | +++ |
| 256 | +++ | +++ | ++++ | +++ |
| 257 | +++ | +++ | ++++ | +++ |
| 258 | +++ | ++ | ++++ | +++ |
| 259 | +++ | +++ | ++++ | +++ |
| 260 | +++ | +++ | ++++ | +++ |
| 261 | +++ | ++ | ++++ | +++ |
| 262 | +++ | ++ | ++++ | +++ |
| 263 | +++ | ++ | ++++ | +++ |
| 264 | +++ | +++ | ++++ | +++ |
| 266 | +++ | ++ | ++++ | +++ |
| 267 | +++ | +++ | ++++ | ++++ |
| 270 | ++++ | +++ | ++++ | +++ |
| 271 | ++++ | +++ | ++++ | ++++ |
| 272 | ++++ | +++ | ++++ | ++++ |
| 276 | +++ | +++ | ++++ | ++++ |
| 277 | +++ | +++ | ++++ | ++++ |
| 278 | +++ | +++ | ++++ | ++++ |
| 279 | ++++ | +++ | ++++ | +++ |
| 280 | +++ | ++ | ++++ | +++ |
| 281 | +++ | + | +++ | ++ |
| 282 | ++ | + | +++ | + |
| 283 | +++ | ++ | +++ | ++ |
| 284 | +++ | ++ | ++++ | +++ |
| 289 | +++ | +++ | ++++ | +++ |

TABLE 4-continued

| SP# | IC50 (MDM2) | IC50 (MDMX) | Ki (MDM2) | Ki (MDMX) |
|---|---|---|---|---|
| 291 | +++ | +++ | ++++ | ++++ |
| 293 | ++++ | +++ | ++++ | +++ |
| 306 | ++++ | ++ | ++++ | +++ |
| 308 | ++ | ++ | +++ | +++ |
| 310 | +++ | +++ | ++++ | +++ |
| 312 | +++ | ++ | +++ | +++ |
| 313 | ++++ | ++ | ++++ | +++ |
| 314 | ++++ | +++ | ++++ | ++++ |
| 315 | +++ | +++ | ++++ | +++ |
| 316 | ++++ | ++ | ++++ | +++ |
| 317 | +++ | ++ | +++ | +++ |
| 318 | +++ | ++ | +++ | +++ |
| 319 | +++ | ++ | +++ | ++ |
| 320 | +++ | ++ | +++ | ++ |
| 321 | +++ | ++ | ++++ | +++ |
| 322 | +++ | ++ | +++ | ++ |
| 323 | +++ | + | +++ | ++ |
| 328 | +++ | +++ | ++++ | +++ |
| 329 | +++ | +++ | ++++ | +++ |
| 331 | ++++ | +++ | ++++ | ++++ |
| 332 | ++++ | +++ | ++++ | ++++ |
| 334 | ++++ | +++ | ++++ | ++++ |
| 336 | ++++ | +++ | ++++ | ++++ |
| 339 | ++++ | ++ | ++++ | +++ |
| 341 | +++ | +++ | ++++ | ++++ |
| 343 | +++ | +++ | ++++ | ++++ |
| 347 | +++ | +++ | ++++ | +++ |
| 349 | ++++ | +++ | ++++ | ++++ |
| 351 | ++++ | +++ | ++++ | ++++ |
| 353 | ++++ | +++ | ++++ | ++++ |
| 355 | ++++ | +++ | ++++ | ++++ |
| 357 | ++++ | +++ | ++++ | ++++ |
| 359 | ++++ | +++ | ++++ | +++ |
| 360 | ++++ | ++++ | ++++ | ++++ |
| 363 | +++ | +++ | ++++ | ++++ |
| 364 | +++ | +++ | ++++ | ++++ |
| 365 | +++ | +++ | ++++ | ++++ |
| 366 | +++ | +++ | ++++ | +++ |
| 369 | ++ | ++ | +++ | +++ |
| 370 | +++ | +++ | ++++ | +++ |
| 371 | ++ | ++ | +++ | +++ |
| 372 | ++ | ++ | +++ | +++ |
| 373 | +++ | +++ | +++ | +++ |
| 374 | +++ | +++ | ++++ | ++++ |
| 375 | +++ | +++ | ++++ | ++++ |
| 376 | +++ | +++ | ++++ | ++++ |
| 377 | +++ | +++ | ++++ | +++ |
| 378 | +++ | +++ | ++++ | +++ |
| 379 | +++ | +++ | ++++ | +++ |
| 380 | +++ | +++ | ++++ | +++ |
| 381 | +++ | +++ | ++++ | +++ |
| 382 | +++ | +++ | ++++ | ++++ |
| 384 | ++ | + | ++ | + |
| 386 | ++ | + | ++ | + |
| 388 | ++ | +++ | +++ | ++++ |
| 390 | +++ | +++ | ++++ | +++ |
| 392 | +++ | +++ | ++++ | ++++ |
| 394 | ++++ | +++ | ++++ | ++++ |
| 396 | ++++ | ++++ | ++++ | ++++ |
| 398 | +++ | +++ | ++++ | +++ |
| 402 | ++++ | ++++ | ++++ | ++++ |
| 404 | +++ | +++ | ++++ | ++++ |
| 408 | +++ | +++ | ++++ | +++ |
| 410 | ++++ | ++++ | ++++ | ++++ |
| 411 | ++ | + | ++ | + |
| 412 | ++++ | +++ | ++++ | ++++ |
| 415 | ++++ | ++++ | ++++ | ++++ |
| 416 | +++ | +++ | ++++ | +++ |
| 417 | +++ | +++ | ++++ | +++ |
| 418 | ++++ | +++ | ++++ | ++++ |
| 419 | +++ | +++ | +++ | ++++ |
| 421 | ++++ | ++++ | ++++ | ++++ |
| 423 | +++ | +++ | ++++ | +++ |
| 425 | +++ | +++ | +++ | +++ |
| 427 | ++ | ++ | +++ | +++ |
| 432 | ++++ | +++ | ++++ | ++++ |
| 434 | +++ | +++ | ++++ | +++ |
| 435 | ++++ | +++ | ++++ | ++++ |
| 437 | +++ | +++ | ++++ | +++ |
| 439 | ++++ | +++ | ++++ | ++++ |
| 441 | ++++ | ++++ | ++++ | ++++ |
| 443 | +++ | +++ | ++++ | +++ |
| 445 | +++ | ++ | ++++ | +++ |
| 446 | +++ | + | ++++ | + |
| 447 | ++ | + | ++ | + |
| 551 | N/A | N/A | ++++ | +++ |
| 555 | N/A | N/A | ++++ | +++ |
| 556 | N/A | N/A | ++++ | +++ |
| 557 | N/A | N/A | +++ | +++ |
| 558 | N/A | N/A | +++ | +++ |
| 559 | N/A | N/A | +++ | +++ |
| 560 | N/A | N/A | + | + |
| 561 | N/A | N/A | ++++ | +++ |
| 562 | N/A | N/A | +++ | +++ |
| 563 | N/A | N/A | +++ | +++ |
| 564 | N/A | N/A | ++++ | +++ |
| 565 | N/A | N/A | +++ | +++ |
| 566 | N/A | N/A | ++++ | +++ |
| 567 | N/A | N/A | ++++ | +++ |
| 568 | N/A | N/A | ++++ | ++++ |
| 569 | N/A | N/A | ++++ | +++ |
| 570 | N/A | N/A | ++++ | +++ |
| 571 | N/A | N/A | ++++ | +++ |
| 572 | N/A | N/A | +++ | +++ |
| 573 | N/A | N/A | +++ | +++ |
| 574 | N/A | N/A | ++++ | +++ |
| 575 | N/A | N/A | ++++ | +++ |
| 576 | N/A | N/A | ++++ | +++ |
| 577 | N/A | N/A | ++++ | +++ |
| 578 | N/A | N/A | ++++ | +++ |
| 585 | N/A | N/A | +++ | +++ |
| 586 | N/A | N/A | ++++ | +++ |
| 587 | N/A | N/A | ++++ | ++++ |
| 589 | N/A | N/A | ++++ | |
| 594 | N/A | N/A | ++++ | ++++ |
| 596 | N/A | N/A | ++++ | +++ |
| 597 | N/A | N/A | ++++ | +++ |
| 598 | N/A | N/A | ++++ | +++ |
| 600 | N/A | N/A | ++++ | ++++ |
| 602 | N/A | N/A | ++++ | ++++ |
| 603 | N/A | N/A | ++++ | ++++ |
| 604 | N/A | N/A | +++ | +++ |
| 608 | N/A | N/A | ++++ | +++ |
| 609 | N/A | N/A | ++++ | +++ |
| 610 | N/A | N/A | ++++ | +++ |
| 611 | N/A | N/A | ++++ | +++ |
| 612 | N/A | N/A | ++++ | +++ |
| 613 | N/A | N/A | ++++ | +++ |
| 615 | N/A | N/A | ++++ | ++++ |
| 433 | N/A | N/A | ++++ | +++ |
| 686 | N/A | N/A | ++++ | +++ |
| 687 | N/A | N/A | ++ | ++ |
| 595 | N/A | N/A | + | N/A |
| 665 | N/A | N/A | +++ | N/A |
| 708 | N/A | N/A | +++ | +++ |
| 710 | N/A | N/A | +++ | +++ |
| 711 | N/A | N/A | +++ | ++ |
| 712 | N/A | N/A | ++++ | ++++ |
| 713 | N/A | N/A | ++++ | ++++ |
| 716 | N/A | N/A | ++++ | ++++ |
| 765 | + | + | | |
| 766 | +++ | + | | |
| 752 | ++ | + | | |
| 753 | +++ | + | | |
| 754 | ++ | + | | |
| 755 | ++++ | + | | |
| 756 | +++ | + | | |
| 757 | ++++ | + | | |
| 758 | +++ | + | | |

Example 9

Competition Binding ELISA (MDM2 & MDMX)

p53-His6 protein ("His6" disclosed as SEQ ID NO: 1501) (30 nM/well) is coated overnight at room temperature in the wells of a 96-well Immulon plates. On the day of the experiment, plates are washed with 1×PBS-Tween 20 (0.05%) using an automated ELISA plate washer, blocked with ELISA Micro well Blocking for 30 minutes at room temperature; excess blocking agent is washed off by washing plates with 1×PBS-Tween 20 (0.05%). Peptides are diluted from 10 mM DMSO stocks to 500 µM working stocks in sterile water, further dilutions made in 0.5% DMSO to keep the concentration of DMSO constant across the samples. The peptides are added to wells at 2× desired concentrations in 50 µl volumes, followed by addition of diluted GST-MDM2 or GST-HMDX protein (final concentration: 10 nM). Samples are incubated at room temperature for 2 h, plates are washed with PBS-Tween 20 (0.05%) prior to adding 100 µl of HRP-conjugated anti-GST antibody [Hypromatrix, INC] diluted to 0.5 µg/ml in HRP-stabilizing buffer. Post 30 min incubation with detection antibody, plates are washed and incubated with 100 µl per well of TMB-E Substrate solution up to 30 minutes; reactions are stopped using 1M HCL and absorbance measured at 450 nm on micro plate reader. Data is analyzed using Graph Pad PRISM software.

Example 10

Cell Viability Assay

The assay was performed according to the following general protocol:

Cell Plating: Trypsinize, count and seed cells at the pre-determined densities in 96-well plates a day prior to assay. Following cell densities are used for each cell line in use:

SJSA-1: 7500 cells/well
RKO: 5000 cells/well
RKO-E6: 5000 cells/well
HCT-116: 5000 cells/well
SW-480: 2000 cells/well
MCF-7: 5000 cells/well On the day of study, replace media with fresh media with 11% FBS (assay media) at room temperature. Add 180 µL of the assay media per well. Control wells with no cells, receive 200 µl media.

Peptide dilution: all dilutions are made at room temperature and added to cells at room temperature.

Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water. This gives range of 10× working stocks. Also prepare DMSO/sterile water (3% DMSO) mix for control wells.

Thus the working stocks concentration range µM will be 300, 100, 30, 10, 3, 1, 0.3 and 0 µM. Mix well at each dilution step using multichannel.

Row H has controls. H1-H3 will receive 20 ul of assay media. H4-H9 will receive 20 ul of 3% DMSO-water vehicle. H10-H12 will have media alone control with no cells.

Positive control: MDM2 small molecule inhibitor, Nutlin-3a (10 mM) is used as positive control. Nutlin was diluted using the same dilution scheme as peptides.

Addition of working stocks to cells:

Add 20 µl of 10× desired concentration to appropriate well to achieve the final concentrations in total 200 µl volume in well. (20 µl of 300 µM peptide+180 µl of cells in media=30 µM final concentration in 200 µl volume in wells). Mix gently a few times using pipette. Thus final concentration range used will be 30, 10, 3, 1, 0.3, 0.1, 0.03 & 0 µM (for potent peptides further dilutions are included).

Controls include wells that get no peptides but contain the same concentration of DMSO as the wells containing the peptides, and wells containing NO CELLS.

Incubate for 72 hours at 37° C. in humidified 5% $CO_2$ atmosphere.

The viability of cells is determined using MTT reagent from Promega. Viability of SJSA-1, RKO, RKO-E6, HCT-116 cells is determined on day 3, MCF-7 cells on day 5 and SW-480 cells on day 6. At the end of designated incubation time, allow the plates to come to room temperature. Remove 80 µl of assay media from each well. Add 15 µl of thawed MTT reagent to each well.

Allow plate to incubate for 2 h at 37° C. in humidified 5% $CO_2$ atmosphere and add 100 µl solubilization reagent as per manufacturer's protocol. Incubate with agitation for 1 h at room temperature and read on Synergy Biotek multiplate reader for absorbance at 570 nM.

Analyze the cell viability against the DMSO controls using GraphPad PRISM analysis tools.

Reagents:
Invitrogen cell culture Media
  i. Falcon 96-well clear cell culture treated plates (Nunc 353072)
DMSO (Sigma D 2650)
RPMI 1640 (Invitrogen 72400)
MTT (Promega G4000)

Instruments:
Multiplate Reader for Absorbance readout (Synergy 2).

Results from cell viability assays are shown in Tables 5 and 6. The following scale is used: "+" represents a value greater than 30 µM, "++" represents a value greater than 15 µM and less than or equal to 30 µM, "+++" represents a value greater than 5 µM and less than or equal to 15 µM, and "++++" represents a value of less than or equal to 5 µM. "IC50 ratio" represents the ratio of average IC50 in p53+/+ cells relative to average IC50 in p53−/− cells.

TABLE 5

| SP# | SJSA-1 EC50 (72 h) |
|---|---|
| 3 | +++ |
| 4 | +++ |
| 5 | ++++ |
| 6 | ++ |
| 7 | ++++ |
| 8 | +++ |
| 9 | +++ |
| 10 | +++ |
| 11 | ++++ |
| 12 | ++ |
| 13 | +++ |
| 14 | + |
| 15 | ++ |
| 16 | + |

TABLE 5-continued

| SP# | SJSA-1 EC50 (72 h) |
|---|---|
| 17 | + |
| 18 | + |
| 19 | ++ |
| 20 | + |
| 21 | + |
| 22 | + |
| 24 | +++ |
| 26 | ++++ |
| 28 | + |
| 29 | + |
| 30 | + |
| 32 | ++ |
| 38 | + |
| 39 | + |
| 40 | + |
| 41 | + |
| 42 | + |
| 43 | ++ |
| 45 | + |
| 46 | + |
| 47 | + |
| 48 | + |
| 49 | +++ |
| 50 | ++++ |
| 52 | + |
| 54 | + |
| 55 | + |
| 65 | ++++ |
| 68 | ++++ |
| 69 | ++++ |
| 70 | ++++ |
| 71 | ++++ |
| 72 | ++++ |
| 74 | ++++ |
| 75 | ++++ |
| 77 | ++++ |
| 78 | ++ |
| 80 | ++++ |
| 81 | +++ |
| 82 | +++ |
| 83 | +++ |
| 84 | + |
| 85 | +++ |
| 99 | ++++ |
| 102 | +++ |
| 103 | +++ |
| 104 | +++ |
| 105 | +++ |
| 108 | +++ |
| 109 | +++ |
| 110 | +++ |
| 111 | ++ |
| 114 | ++++ |
| 115 | ++++ |
| 118 | ++++ |
| 120 | ++++ |
| 121 | ++++ |
| 122 | ++++ |
| 123 | ++++ |
| 124 | +++ |
| 125 | ++++ |
| 126 | ++++ |
| 127 | ++++ |
| 128 | +++ |
| 129 | ++ |
| 130 | ++++ |
| 131 | +++ |
| 132 | ++++ |
| 133 | +++ |
| 134 | +++ |
| 135 | +++ |
| 136 | ++ |
| 137 | +++ |
| 139 | ++++ |
| 142 | +++ |
| 144 | ++++ |
| 147 | ++++ |
| 148 | ++++ |
| 149 | ++++ |
| 150 | ++++ |
| 152 | +++ |
| 153 | ++++ |
| 154 | ++++ |
| 155 | ++ |
| 156 | +++ |
| 157 | +++ |
| 158 | +++ |
| 160 | ++++ |
| 161 | ++++ |
| 162 | +++ |
| 163 | +++ |
| 166 | ++ |
| 167 | +++ |
| 168 | ++ |
| 169 | ++++ |
| 170 | ++++ |
| 171 | ++ |
| 173 | +++ |
| 174 | ++++ |
| 175 | +++ |
| 176 | +++ |
| 177 | ++++ |
| 179 | +++ |
| 180 | +++ |
| 181 | +++ |
| 182 | ++++ |
| 183 | ++++ |
| 184 | +++ |
| 185 | +++ |
| 186 | ++ |
| 188 | ++ |
| 190 | ++++ |
| 192 | +++ |
| 193 | ++ |
| 194 | + |
| 195 | ++++ |
| 196 | ++++ |
| 197 | ++++ |
| 198 | ++ |
| 199 | +++ |
| 200 | +++ |
| 201 | ++++ |
| 202 | +++ |
| 203 | ++++ |
| 204 | ++++ |
| 205 | ++ |
| 206 | ++ |
| 207 | +++ |
| 208 | +++ |
| 209 | ++++ |
| 210 | +++ |
| 211 | ++++ |
| 213 | ++++ |
| 214 | ++++ |
| 215 | ++++ |
| 216 | ++++ |
| 217 | ++++ |
| 218 | ++++ |
| 219 | ++++ |
| 220 | +++ |
| 221 | ++++ |
| 222 | +++ |
| 223 | ++++ |
| 224 | ++ |
| 225 | +++ |
| 226 | ++ |
| 227 | +++ |
| 228 | ++++ |
| 229 | ++++ |
| 230 | ++++ |
| 231 | ++++ |
| 232 | ++++ |
| 233 | ++++ |
| 234 | ++++ |

TABLE 5-continued

| SP# | SJSA-1 EC50 (72 h) |
|---|---|
| 235 | ++++ |
| 236 | ++++ |
| 237 | ++++ |
| 238 | ++++ |
| 239 | +++ |
| 240 | ++ |
| 241 | +++ |
| 242 | ++++ |
| 243 | ++++ |
| 244 | ++++ |
| 245 | ++++ |
| 246 | +++ |
| 247 | ++++ |
| 248 | ++++ |
| 249 | ++++ |
| 250 | ++ |
| 251 | + |
| 252 | + |
| 253 | + |
| 254 | +++ |
| 255 | +++ |
| 256 | ++ |
| 257 | +++ |
| 258 | +++ |
| 259 | ++ |
| 260 | ++ |
| 261 | ++ |
| 262 | +++ |
| 263 | ++ |
| 264 | ++++ |
| 266 | +++ |
| 267 | ++++ |
| 270 | ++ |
| 271 | ++ |
| 272 | ++ |
| 276 | ++ |
| 277 | ++ |
| 278 | ++ |
| 279 | ++++ |
| 280 | +++ |
| 281 | ++ |
| 282 | ++ |
| 283 | ++ |
| 284 | ++++ |
| 289 | ++++ |
| 290 | +++ |
| 291 | ++++ |
| 292 | ++++ |
| 293 | ++++ |
| 294 | ++++ |
| 295 | +++ |
| 296 | ++++ |
| 297 | +++ |
| 298 | ++++ |
| 300 | ++++ |
| 301 | ++++ |
| 302 | ++++ |
| 303 | ++++ |
| 304 | ++++ |
| 305 | ++++ |
| 306 | ++++ |
| 307 | +++ |
| 308 | ++++ |
| 309 | +++ |
| 310 | ++++ |
| 312 | ++++ |
| 313 | ++++ |
| 314 | ++++ |
| 315 | ++++ |
| 316 | ++++ |
| 317 | ++++ |
| 318 | ++++ |
| 319 | ++++ |
| 320 | ++++ |
| 321 | ++++ |
| 322 | ++++ |
| 323 | ++++ |
| 324 | ++++ |
| 326 | ++++ |
| 327 | ++++ |
| 328 | ++++ |
| 329 | ++++ |
| 330 | ++++ |
| 331 | ++++ |
| 332 | ++++ |
| 333 | ++ |
| 334 | +++ |
| 335 | ++++ |
| 336 | ++++ |
| 337 | ++++ |
| 338 | ++++ |
| 339 | ++++ |
| 340 | ++++ |
| 341 | ++++ |
| 342 | ++++ |
| 343 | ++++ |
| 344 | ++++ |
| 345 | ++++ |
| 346 | ++++ |
| 347 | ++++ |
| 348 | ++++ |
| 349 | ++++ |
| 350 | ++++ |
| 351 | ++++ |
| 352 | ++++ |
| 353 | ++++ |
| 355 | ++++ |
| 357 | ++++ |
| 358 | ++++ |
| 359 | ++++ |
| 360 | ++++ |
| 361 | +++ |
| 362 | ++++ |
| 363 | ++++ |
| 364 | ++++ |
| 365 | +++ |
| 366 | ++++ |
| 367 | ++++ |
| 368 | + |
| 369 | ++++ |
| 370 | ++++ |
| 371 | ++++ |
| 372 | +++ |
| 373 | +++ |
| 374 | ++++ |
| 375 | ++++ |
| 376 | ++++ |
| 377 | ++++ |
| 378 | ++++ |
| 379 | ++++ |
| 380 | ++++ |
| 381 | ++++ |
| 382 | ++++ |
| 386 | +++ |
| 388 | ++ |
| 390 | ++++ |
| 392 | +++ |
| 394 | +++ |
| 396 | +++ |
| 398 | +++ |
| 402 | +++ |
| 404 | +++ |
| 408 | ++++ |
| 410 | +++ |
| 411 | +++ |
| 412 | + |
| 421 | +++ |
| 423 | ++++ |
| 425 | ++++ |
| 427 | ++++ |
| 434 | +++ |
| 435 | ++++ |
| 436 | ++++ |
| 437 | ++++ |

TABLE 5-continued

| SP# | SJSA-1 EC50 (72 h) |
|---|---|
| 438 | ++++ |
| 439 | ++++ |
| 440 | ++++ |
| 441 | ++++ |
| 442 | ++++ |
| 443 | ++++ |
| 444 | +++ |
| 445 | ++++ |
| 449 | ++++ |
| 551 | ++++ |
| 552 | ++++ |
| 554 | + |
| 555 | ++++ |
| 557 | ++++ |
| 558 | ++++ |
| 560 | + |
| 561 | ++++ |
| 562 | ++++ |
| 563 | ++++ |
| 564 | ++++ |
| 566 | ++++ |
| 567 | ++++ |
| 568 | +++ |
| 569 | ++++ |
| 571 | ++++ |
| 572 | ++++ |
| 573 | ++++ |
| 574 | ++++ |
| 575 | ++++ |
| 576 | ++++ |
| 577 | ++++ |
| 578 | ++++ |
| 585 | ++++ |
| 586 | ++++ |
| 587 | ++++ |
| 588 | ++++ |
| 589 | +++ |
| 432 | ++++ |
| 672 | + |
| 673 | ++ |
| 682 | + |
| 686 | + |
| 687 | + |
| 662 | ++++ |
| 663 | ++++ |
| 553 | +++ |
| 559 | ++++ |
| 579 | ++++ |
| 581 | ++++ |
| 582 | ++ |
| 582 | ++++ |
| 584 | +++ |
| 675 | ++++ |
| 676 | ++++ |
| 677 | + |
| 679 | ++++ |
| 700 | +++ |
| 704 | +++ |
| 591 | + |
| 706 | ++ |
| 695 | ++ |
| 595 | ++++ |
| 596 | ++++ |
| 597 | +++ |
| 598 | +++ |
| 599 | ++++ |
| 600 | ++++ |
| 601 | +++ |
| 602 | +++ |
| 603 | +++ |
| 604 | +++ |
| 606 | ++++ |
| 607 | ++++ |
| 608 | ++++ |
| 610 | ++++ |
| 611 | ++++ |
| 612 | ++++ |
| 613 | +++ |
| 614 | +++ |
| 615 | ++++ |
| 618 | ++++ |
| 619 | ++++ |
| 707 | ++++ |
| 620 | ++++ |
| 621 | ++++ |
| 622 | ++++ |
| 623 | ++++ |
| 624 | ++++ |
| 625 | ++++ |
| 626 | +++ |
| 631 | ++++ |
| 633 | ++++ |
| 634 | ++++ |
| 635 | +++ |
| 636 | +++ |
| 638 | + |
| 641 | +++ |
| 665 | ++++ |
| 708 | ++++ |
| 709 | +++ |
| 710 | + |
| 711 | ++++ |
| 712 | ++++ |
| 713 | ++++ |
| 714 | +++ |
| 715 | +++ |
| 716 | ++++ |
| 765 | + |
| 753 | + |
| 754 | + |
| 755 | + |
| 756 | + |
| 757 | ++++ |
| 758 | +++ |

TABLE 6

| SP# | HCT-116 EC50 (72 h) | RKO EC50 (72 h) | RKO-E6 EC50 (72 h) | SW480 EC50 (6 days) | IC50 Ratio |
|---|---|---|---|---|---|
| 4 | ++++ | ++++ | +++ | ++++ | |
| 5 | ++++ | ++++ | +++ | ++++ | |
| 7 | ++++ | ++++ | +++ | ++++ | |
| 10 | ++++ | +++ | +++ | +++ | |
| 11 | ++++ | ++++ | ++ | +++ | |
| 50 | ++++ | ++++ | ++ | +++ | |
| 65 | +++ | +++ | +++ | +++ | |
| 69 | ++++ | ++++ | + | ++++ | |
| 70 | ++++ | ++++ | ++ | +++ | |
| 71 | ++++ | ++++ | +++ | +++ | |
| 81 | +++ | +++ | +++ | +++ | |
| 99 | ++++ | ++++ | +++ | ++++ | |
| 109 | ++++ | ++++ | ++ | +++ | |
| 114 | | +++ | + | +++ | |
| 115 | | +++ | + | +++ | 1-29 |
| 118 | +++ | ++++ | + | ++++ | |
| 120 | ++++ | ++++ | + | ++++ | |
| 121 | ++++ | ++++ | + | ++++ | |
| 122 | | +++ | + | +++ | 1-29 |
| 125 | +++ | +++ | + | + | |
| 126 | + | + | + | + | |
| 148 | | ++ | + | + | |
| 150 | | ++ | + | + | |
| 153 | +++ | | | + | |
| 154 | +++ | +++ | + | + | 30-49 |
| 158 | + | + | + | + | |
| 160 | +++ | + | + | + | 1-29 |
| 161 | +++ | + | + | + | |
| 175 | + | + | + | + | |
| 196 | ++++ | ++++ | +++ | ++++ | |

TABLE 6-continued

| SP# | HCT-116 EC50 (72 h) | RKO EC50 (72 h) | RKO-E6 EC50 (72 h) | SW480 EC50 (6 days) | IC50 Ratio |
|---|---|---|---|---|---|
| 219 | ++++ | +++ | + | + | 1-29 |
| 233 | ++++ | | | | |
| 237 | ++++ | | + | + | |
| 238 | ++++ | | + | + | |
| 243 | ++++ | | + | + | |
| 244 | ++++ | | + | + | ≥50 |
| 245 | ++++ | | + | + | |
| 247 | ++++ | | + | + | |
| 249 | ++++ | ++++ | + | + | ≥50 |
| 255 | ++++ | | + | | |
| 291 | | | + | | |
| 293 | +++ | | + | | |
| 303 | +++ | | + | | 1-29 |
| 305 | | | + | | |
| 306 | ++++ | | + | | |
| 310 | ++++ | | + | | |
| 312 | ++++ | | | | |
| 313 | ++++ | | ++ | | |
| 314 | | | + | | |
| 315 | ++++ | ++++ | ++ | ++++ | ≥50 |
| 316 | ++++ | ++++ | + | +++ | ≥50 |
| 317 | +++ | | + | ++ | |
| 321 | ++++ | | + | | |
| 324 | +++ | | + | | |
| 325 | +++ | | | | |
| 326 | +++ | | + | | |
| 327 | +++ | | + | | |
| 328 | +++ | | ++ | | |
| 329 | ++++ | | + | | |
| 330 | | | + | | |
| 331 | ++++ | ++++ | + | + | ≥50 |
| 338 | ++++ | ++++ | ++ | +++ | |
| 341 | +++ | ++ | + | + | |
| 343 | +++ | | + | + | |
| 346 | ++++ | | + | + | |
| 347 | +++ | | + | + | |
| 349 | ++++ | +++ | + | + | 30-49 |
| 350 | ++++ | | + | + | |
| 351 | ++++ | +++ | + | + | 30-49 |
| 353 | ++ | ++ | + | + | |
| 355 | ++++ | ++ | + | + | 1-29 |
| 357 | ++++ | ++++ | + | + | |
| 358 | ++++ | ++ | + | + | |
| 359 | ++++ | ++ | + | + | |
| 367 | ++++ | | + | + | 30-49 |
| 386 | ++++ | ++++ | ++++ | ++++ | |
| 388 | ++ | ++ | + | +++ | 1-29 |
| 390 | ++++ | ++++ | +++ | ++++ | |
| 435 | +++ | ++ | + | | |
| 436 | ++++ | ++++ | ++ | | |
| 437 | ++++ | ++++ | ++ | ++++ | 30-49 |
| 440 | ++ | ++ | + | | |
| 442 | ++++ | ++++ | ++ | | |
| 444 | ++++ | ++++ | +++ | | |
| 445 | ++++ | +++ | + | + | ≥50 |
| 555 | | | | | ≥50 |
| 557 | | | | | ≥50 |
| 558 | | | | | 30-49 |
| 562 | | | | | 30-49 |
| 564 | | | | | 30-49 |
| 566 | | | | | 30-49 |
| 567 | | | | | ≥50 |
| 572 | | | | | ≥50 |
| 573 | | | | | 30-49 |
| 578 | | | | | 30-49 |
| 662 | | | | | ≥50 |
| 379 | | | | | 1-29 |
| 375 | | | | | 1-29 |
| 559 | | | | | ≥50 |
| 561 | | | | | 1-29 |
| 563 | | | | | 1-29 |
| 568 | | | | | 1-29 |
| 569 | | | | | 1-29 |
| 571 | | | | | 1-29 |
| 574 | | | | | 1-29 |
| 575 | | | | | 1-29 |
| 576 | | | | | 1-29 |
| 577 | | | | | 30-49 |
| 433 | | | | | 1-29 |
| 551 | | | | | 30-49 |
| 553 | | | | | 1-29 |
| 710 | | | | + | |
| 711 | | | | + | |
| 712 | | | | ++ | |
| 713 | | | | ++ | |
| 714 | | | | +++ | |
| 715 | | | | +++ | |
| 716 | | | | + | |

Example 11 p21 ELISA Assay

The assay was performed according to the following general protocol:

Cell Plating:
Trypsinize, count and seed SJSA1 cells at the density of 7500 cells/100 μl/well in 96-well plates a day prior to assay.

On the day of study, replace media with fresh RPMI-11% FBS (assay media). Add 90 μL of the assay media per well. Control wells with no cells, receive 100 μl media.

Peptide dilution:
Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water. This gives range of 10× working stocks. Also prepare DMSO/sterile water (3% DMSO) mix for control wells.

Thus the working stocks concentration range μM will be 300, 100, 30, 10, 3, 1, 0.3 and 0 μM. Mix well at each dilution step using multichannel.

Row H has controls. H1-H3 will receive 10 ul of assay media. H4-H9 will receive 10 ul of 3% DMSO-water vehicle. H10-H12 will have media alone control with no cells.

Positive control: MDM2 small molecule inhibitor, Nutlin-3a (10 mM) is used as positive control. Nutlin was diluted using the same dilution scheme as peptides.

Addition of working stocks to cells:
Add 10 μl of 10× desired concentration to appropriate well to achieve the final concentrations in total 100 μl volume in well. (10 μl of 300 μM peptide+90 μl of cells in media=30 μM final concentration in 100 μl volume in wells). Thus final concentration range used will be 30, 10, 3, 1, 0.3 & 0 μM.

Controls will include wells that get no peptides but contain the same concentration of DMSO as the wells containing the peptides, and wells containing NO CELLS.

20 h-post incubation, aspirate the media; wash cells with 1×PBS (without $Ca^{++}/Mg^{++}$) and lyse in 60 μl of 1× Cell lysis buffer (Cell Signaling technologies 10× buffer diluted to 1× and supplemented with protease inhibitors and Phosphatase inhibitors) on ice for 30 min Centrifuge plates in at 5000 rpm speed in at 4° C. for 8 min; collect clear supernatants and freeze at −80° C. till further use.

Protein Estimation:
Total protein content of the lysates is measured using BCA protein detection kit and BSA standards from Thermofisher. Typically about 6-7 µg protein is expected per well.
Use 50 µl of the lysate per well to set up p21 ELISA.
Human Total p21 ELISA:
The ELISA assay protocol is followed as per the manufacturer's instructions. 50 µl lysate is used for each well, and each well is set up in triplicate.
Reagents:
Cell-Based Assay (−)-Nutlin-3 (10 mM): Cayman Chemicals, catalog #600034
OptiMEM, Invitrogen catalog #51985
Cell Signaling Lysis Buffer (10×), Cell signaling technology, Catalog #9803
Protease inhibitor Cocktail tablets(mini), Roche Chemicals, catalog #04693124001
Phosphatase inhibitor Cocktail tablet, Roche Chemicals, catalog #04906837001
Human total p21 ELISA kit, R&D Systems, DYC1047-5
STOP Solution (1M HCL), Cell Signaling Technologies, Catalog #7002
Instruments: Micro centrifuge-Eppendorf 5415D and Multiplate Reader for Absorbance readout (Synergy 2).

Example 12

Caspase 3 Detection Assay

The assay was performed according to the following general protocol:
Cell Platimg:
Trypsinize, count and seed SJSA1 cells at the density of 7500 cells/100 µl/well in 96-well plates a day prior to assay. On the day of study, replace media with fresh RPMI-11% FBS (assay media). Add 180 µL of the assay media per well. Control wells with no cells, receive 200 µl media.

Peptide dilution:
Prepare 10 mM stocks of the peptides in DMSO. Serially dilute the stock using 1:3 dilution scheme to get 10, 3.3, 1.1, 0.33, 0.11, 0.03, 0.01 mM solutions using DMSO as diluents. Dilute the serially DMSO-diluted peptides 33.3 times using sterile water. This gives range of 10× working stocks. Also prepare DMSO/sterile water (3% DMSO) mix for control wells.
Thus the working stocks concentration range µM will be 300, 100, 30, 10, 3, 1, 0.3 and 0 µM. Mix well at each dilution step using multichannel. Add 20 ul of 10× working stocks to appropriate wells.
Row H has controls. H1-H3 will receive 20 ul of assay media. H4-H9 will receive 20 ul of 3% DMSO-water vehicle. H10-H12 will have media alone control with no cells.
Positive control: MDM2 small molecule inhibitor, Nutlin-3a (10 mM) is used as positive control. Nutlin was diluted using the same dilution scheme as peptides.
Addition of working stocks to cells:
Add 10 µl of 10× desired concentration to appropriate well to achieve the final concentrations in total 100 µl volume in well. (10 µl of 300 µM peptide+90 µl of cells in media=30 µM final concentration in 100 µl volume in wells). Thus final concentration range used will be 30, 10, 3, 1, 0.3 & 0 µM.
Controls will include wells that get no peptides but contain the same concentration of DMSO as the wells containing the peptides, and wells containing NO CELLS.
48 h-post incubation, aspirate 80 µl media from each well; add 100 µl Caspase3/7Glo assay reagent (Promega Caspase 3/7 glo assay system, G8092) per well, incubate with gentle shaking for 1 h at room temperature.
read on Synergy Biotek multiplate reader for luminescence.
Data is analyzed as Caspase 3 activation over DMSO-treated cells.
Results from Examples 11 and 12 are shown in Table 7:

TABLE 7

| SP# | caspase 0.3 uM | caspase 1 uM | caspase 3 uM | caspase 10 uM | caspase 30 uM | p21 0.3 uM | p21 1 uM | p21 3 uM | p21 10 uM | p21 30 uM |
|---|---|---|---|---|---|---|---|---|---|---|
| 4 | | | 9 | 37 | 35 | | | 317 | 3049 | 3257 |
| 7 | 0.93 | 1.4 | 5.08 | 21.7 | 23.96 | | 18 | 368 | 1687 | 2306 |
| 8 | | | 1 | 19 | 25 | | | 34 | 972 | 2857 |
| 10 | 1 | | 1 | 17 | 32 | | 10 | 89 | 970 | 2250 |
| 11 | 1 | | 5 | 23 | 33.5 | | 140 | 350 | 2075.5 | 3154 |
| 26 | 1 | | 1 | 3 | 14 | | | | | |
| 50 | | | 8 | 29 | 29 | | 44 | 646 | 1923 | 1818 |
| 65 | 1 | | 6 | 28 | 34 | −69 | −24 | 122 | 843 | 1472 |
| 69 | 4.34 | 9.51 | 16.39 | 26.59 | 26.11 | 272 | 458.72 | 1281.39 | 2138.88 | 1447.22 |
| 70 | | | 1 | 9 | 26 | | −19 | 68 | 828 | 1871 |
| 71 | 0.95 | 1.02 | 3.68 | 14.72 | 23.52 | | 95 | 101 | 1204 | 2075 |
| 72 | 1 | | 1 | 4 | 10 | −19 | 57 | 282 | 772 | 1045 |
| 77 | 1 | | 2 | 19 | 23 | | | | | |
| 80 | 1 | | 2 | 13 | 20 | | | | | |
| 81 | 1 | | 1 | 6 | 21 | | 0 | 0 | 417 | 1649 |
| 99 | 1 | | 7 | 31 | 33 | −19 | 117 | 370 | 996 | 1398 |
| 109 | | | 4 | 16 | 25 | | 161 | 445 | 1221 | 1680 |
| 114 | 1 | | 6 | 28 | 34 | −21 | 11 | 116 | 742 | 910 |
| 115 | 1 | | 10 | 26 | 32 | −10 | 36 | 315 | 832 | 1020 |
| 118 | 1 | | 2 | 18 | 27 | −76 | −62 | −11 | 581 | 1270 |
| 120 | 2 | | 11 | 20 | 30 | −4 | 30 | 164 | 756 | 1349 |
| 121 | 1 | | 5 | 19 | 30 | 9 | 33 | 81 | 626 | 1251 |
| 122 | 1 | | 2 | 15 | 30 | −39 | −18 | 59 | 554 | 1289 |
| 123 | 1 | | 1 | 6 | 14 | | | | | |
| 125 | 1 | | 3 | 9 | 29 | 50 | 104 | 196 | 353 | 1222 |
| 126 | 1 | | 1 | 6 | 30 | −47 | −10 | 90 | 397 | 1443 |
| 127 | 1 | | 1 | 4 | 13 | | | | | |

TABLE 7-continued

| SP# | caspase 0.3 uM | caspase 1 uM | caspase 3 uM | caspase 10 uM | caspase 30 uM | p21 0.3 uM | p21 1 uM | p21 3 uM | p21 10 uM | p21 30 uM |
|---|---|---|---|---|---|---|---|---|---|---|
| 130 | 1 |  | 2 | 6 | 17 |  |  |  |  |  |
| 139 | 1 |  | 2 | 9 | 18 |  |  |  |  |  |
| 142 | 1 |  | 2 | 15 | 20 |  |  |  |  |  |
| 144 | 1 |  | 4 | 10 | 16 |  |  |  |  |  |
| 148 | 1 |  | 11 | 23 | 31 | −23 | 55 | 295 | 666 | 820 |
| 149 | 1 |  | 2 | 4 | 10 | 35 | 331 | 601 | 1164 | 1540 |
| 150 | 2 |  | 11 | 19 | 35 | −37 | 24 | 294 | 895 | 906 |
| 153 | 2 |  | 10 | 15 | 20 |  |  |  |  |  |
| 154 | 2.68 | 4 | 13.93 | 19.86 | 30.14 | 414.04 | 837.45 | 1622.42 | 2149.51 | 2156.98 |
| 158 | 1 |  | 1.67 | 5 | 16.33 | −1.5 | 95 | 209.5 | 654 | 1665.5 |
| 160 | 2 |  | 10 | 16 | 31 | −43 | 46 | 373 | 814 | 1334 |
| 161 | 2 |  | 8 | 14 | 22 | 13 | 128 | 331 | 619 | 1078 |
| 170 | 1 |  | 1 | 16 | 20 |  |  |  |  |  |
| 175 | 1 |  | 5 | 12 | 21 | −65 | 1 | 149 | 543 | 1107 |
| 177 | 1 |  | 1 | 8 | 20 |  |  |  |  |  |
| 183 | 1 |  | 1 | 4 | 8 | −132 | −119 | −14 | 1002 | 818 |
| 196 | 1 |  | 4 | 33 | 26 | −49 | −1 | 214 | 1715 | 687 |
| 197 | 1 |  | 1 | 10 | 20 |  |  |  |  |  |
| 203 | 1 |  | 3 | 12 | 10 | 77 | 329 | 534 | 1805 | 380 |
| 204 | 1 |  | 4 | 10 | 10 | 3 | 337 | 928 | 1435 | 269 |
| 218 | 1 |  | 2 | 8 | 18 |  |  |  |  |  |
| 219 | 1 |  | 5 | 17 | 34 | 28 | 53 | 289 | 884 | 1435 |
| 221 | 1 |  | 3 | 6 | 12 | 127 | 339 | 923 | 1694 | 1701 |
| 223 | 1 |  | 1 | 5 | 18 |  |  |  |  |  |
| 230 | 1 |  | 2 | 3 | 11 | 245.5 | 392 | 882 | 1549 | 2086 |
| 233 | 6 | 8 | 17 | 22 | 23 | 2000 | 2489 | 3528 | 3689 | 2481 |
| 237 | 1 |  | 5 | 9 | 15 | 0 | 0 | 2 | 284 | 421 |
| 238 | 1 |  | 2 | 4 | 21 | 0 | 149 | 128 | 825 | 2066 |
| 242 | 1 |  | 4 | 5 | 18 | 0 | 0 | 35 | 577 | 595 |
| 243 | 1 |  | 2 | 5 | 23 | 0 | 0 | 0 | 456 | 615 |
| 244 | 1 |  | 2 | 7 | 17 | 0 | 178 | 190 | 708 | 1112 |
| 245 | 1 |  | 3 | 9 | 16 | 0 | 0 | 0 | 368 | 536 |
| 247 | 1 |  | 3 | 11 | 24 | 0 | 0 | 49 | 492 | 699 |
| 248 |  |  |  |  |  | 0 | 50 | 22 | 174 | 1919 |
| 249 | 2 |  | 5 | 11 | 23 | 0 | 0 | 100 | 907 | 1076 |
| 251 |  |  |  |  |  | 0 | 0 | 0 | 0 | 0 |
| 252 |  |  |  |  |  | 0 | 0 | 0 | 0 | 0 |
| 253 |  |  |  |  |  | 0 | 0 | 0 | 0 | 0 |
| 254 | 1 | 3 | 7 | 14 | 22 | 118 | 896 | 1774 | 3042 | 3035 |
| 286 | 1 | 4 | 11 | 20 | 22 | 481 | 1351 | 2882 | 3383 | 2479 |
| 287 | 1 | 1 | 3 | 11 | 23 | 97 | 398 | 986 | 2828 | 3410 |
| 315 | 11 | 14.5 | 25.5 | 32 | 34 | 2110 | 2209 | 2626 | 2965 | 2635 |
| 316 | 6.5 | 10.5 | 21 | 32 | 32.5 | 1319 | 1718 | 2848 | 2918 | 2540 |
| 317 | 3 | 4 | 9 | 26 | 35 | 551 | 624 | 776 | 1367 | 1076 |
| 331 | 4.5 | 8 | 11 | 14.5 | 30.5 | 1510 | 1649 | 2027 | 2319 | 2509 |
| 338 | 1 | 5 | 23 | 20 | 29 | 660.37 | 1625.38 | 3365.87 | 2897.62 | 2727 |
| 341 | 3 | 8 | 11 | 14 | 21 | 1325.62 | 1873 | 2039.75 | 2360.75 | 2574 |
| 343 | 1 | 1 | 2 | 5 | 29 | 262 | 281 | 450 | 570 | 1199 |
| 346 |  |  |  |  |  | 235.86 | 339.82 | 620.36 | 829.32 | 1695.78 |
| 347 | 2 | 3 | 5 | 8 | 29 | 374 | 622 | 659 | 905 | 1567 |
| 349 | 1 | 8 | 11 | 16 | 24 | 1039.5 | 1598.88 | 1983.75 | 2191.25 | 2576.38 |
| 351 | 3 | 9 | 13 | 15 | 24 | 1350.67 | 1710.67 | 2030.92 | 2190.67 | 2668.54 |
| 353 | 1 | 2 | 5 | 7 | 30 | 390 | 490 | 709 | 931 | 1483 |
| 355 | 1 | 4 | 11 | 13 | 30 | 191 | 688 | 1122 | 1223 | 1519 |
| 357 | 2 | 7 | 11 | 15 | 23 | 539 | 777 | 1080 | 1362 | 1177 |
| 358 | 1 | 2 | 3 | 6 | 24 | 252 | 321 | 434 | 609 | 1192 |
| 359 | 3 | 9 | 11 | 13 | 23 | 1163.29 | 1508.79 | 1780.29 | 2067.67 | 2479.29 |
| 416 |  |  |  |  |  | 33.74 | 39.82 | 56.57 | 86.78 | 1275.28 |
| 417 |  |  |  |  |  | 0 | 0 | 101.13 | 639.04 | 2016.58 |
| 419 |  |  |  |  |  | 58.28 | 97.36 | 221.65 | 1520.69 | 2187.94 |
| 432 |  |  |  |  |  | 54.86 | 68.86 | 105.11 | 440.28 | 1594.4 |

Example 13

Cell Lysis by Peptidomimetic Macrocycles

SJSA-1 cells were plated out one day in advance in clear flat-bottom plates (Costar, catalog number 353072) at 7500 cells/well with 100 ul/well of growth media, leaving row H columns 10-12 empty for media alone. On the day of the assay, media was exchanged with RPMI 1% FBS media, 90 µL of media per well.

10 mM stock solutions of the peptidomimetic macrocycles were prepared in 100% DMSO. Peptidomimetic macrocycles were then diluted serially in 100% DMSO, and then further diluted 20-fold in sterile water to prepare working stock solutions in 5% DMSO/water of each peptidomimetic macrocycle at concentrations ranging from 500 uM to 62.5 uM.

10 uL of each compound was added to the 90 uL of SJSA-1 cells to yield final concentrations of 50 uM to 6.25 uM in 0.5% DMSO-containing media. The negative control (non-lytic) sample was 0.5% DMSO alone and positive control (lytic) samples include 10 uM Melittin and 1% Triton X-100.

Cell plates were incubated for 1 hour at 37 C. After the 1 hour incubation, the morphology of the cells is examined by microscope and then the plates were centrifuged at 1200 rpm for 5 minutes at room temperature. 40 uL of supernatant for each peptidomimetic macrocycle and control sample is transferred to clear assay plates. LDH release is measured using the LDH cytotoxicity assay kit from Caymen, catalog#1000882.

Results are shown in Table 8:

TABLE 8

| SP# | 6.25 uM % Lysed cells (1 h LDH) | 12.5 uM % Lysed cells (1 h LDH) | 25 uM % Lysed cells (1 h LDH) | 50 uM % Lysed cells (1 h LDH) |
|---|---|---|---|---|
| 3 | 1 | 0 | 1 | 3 |
| 4 | −2 | 1 | 1 | 2 |
| 6 | 1 | 1 | 1 | 1 |
| 7 | 0 | 0 | 0 | 0 |
| 8 | −1 | 0 | 1 | 1 |
| 9 | −3 | 0 | 0 | 2 |
| 11 | −2 | 1 | 2 | 3 |
| 15 | 1 | 2 | 2 | 5 |
| 18 | 0 | 1 | 2 | 4 |
| 19 | 2 | 2 | 3 | 21 |
| 22 | 0 | −1 | 0 | 0 |
| 26 | 2 | 5 | −1 | 0 |
| 32 | 0 | 0 | 2 | 0 |
| 39 | 0 | −1 | 0 | 3 |
| 43 | 0 | 0 | −1 | −1 |
| 55 | 1 | 5 | 9 | 13 |
| 65 | 0 | 0 | 0 | 2 |
| 69 | 1 | 0.5 | −0.5 | 5 |
| 71 | 0 | 0 | 0 | 0 |
| 72 | 2 | 1 | 0 | 3 |
| 75 | −1 | 3 | 1 | 1 |
| 77 | −2 | −2 | 1 | −1 |
| 80 | 0 | 1 | 1 | 5 |
| 81 | 1 | 1 | 0 | 0 |
| 82 | 0 | 0 | 0 | 1 |
| 99 | 1.5 | 3 | 2 | 3.5 |
| 108 | 0 | 0 | 0 | 1 |
| 114 | 3 | −1 | 4 | 9 |
| 115 | 0 | 1 | −1 | 6 |
| 118 | 4 | 2 | 2 | 4 |
| 120 | 0 | −1 | 0 | 6 |
| 121 | 1 | 0 | 1 | 7 |
| 122 | 1 | 3 | 0 | 6 |
| 123 | −2 | 2 | 5 | 3 |
| 125 | 0 | 1 | 0 | 2 |
| 126 | 1 | 2 | 1 | 1 |
| 130 | 1 | 3 | 0 | −1 |
| 139 | −2 | −3 | −1 | −1 |
| 142 | 1 | 0 | 1 | 3 |
| 144 | 1 | 2 | −1 | 2 |
| 147 | 8 | 9 | 16 | 55 |
| 148 | 0 | 1 | −1 | 0 |
| 149 | 6 | 7 | 7 | 21 |
| 150 | −1 | −2 | 0 | 2 |
| 153 | 4 | 3 | 2 | 3 |
| 154 | −1 | −1.5 | −1 | −1 |
| 158 | 0 | −6 | −2 | |
| 160 | −1 | 0 | −1 | 1 |
| 161 | 1 | 1 | −1 | 0 |
| 169 | 2 | 3 | 3 | 7 |
| 170 | 2 | 2 | 1 | −1 |
| 174 | 5 | 3 | 2 | 5 |
| 175 | 3 | 2 | 1 | 0 |
| 177 | −1 | −1 | 0 | 1 |
| 182 | 0 | 2 | 3 | 6 |
| 183 | 2 | 1 | 0 | 3 |
| 190 | −1 | −1 | 0 | 1 |
| 196 | 0 | −2 | 0 | 3 |
| 197 | 1 | −4 | −1 | −2 |
| 203 | 0 | −1 | 2 | 2 |
| 204 | 4 | 3 | 2 | 0 |
| 211 | 5 | 4 | 3 | 1 |
| 217 | 2 | 1 | 1 | 2 |
| 218 | 0 | −3 | −4 | 1 |

TABLE 8-continued

| SP# | 6.25 uM % Lysed cells (1 h LDH) | 12.5 uM % Lysed cells (1 h LDH) | 25 uM % Lysed cells (1 h LDH) | 50 uM % Lysed cells (1 h LDH) |
|---|---|---|---|---|
| 219 | 0 | 0 | −1 | 2 |
| 221 | 3 | 3 | 3 | 11 |
| 223 | −2 | −2 | −4 | −1 |
| 230 | 0.5 | −0.5 | 0 | 3 |
| 232 | 6 | 6 | 5 | 5 |
| 233 | 2.5 | 4.5 | 3.5 | 6 |
| 237 | 0 | 3 | 7 | 55 |
| 243 | 4 | 23 | 39 | 64 |
| 244 | 0 | 1 | 0 | 4 |
| 245 | 1 | 14 | 11 | 56 |
| 247 | 0 | 0 | 0 | 4 |
| 249 | 0 | 0 | 0 | 0 |
| 254 | 11 | 34 | 60 | 75 |
| 279 | 6 | 4 | 5 | 6 |
| 280 | 5 | 4 | 6 | 18 |
| 284 | 5 | 4 | 5 | 6 |
| 286 | 0 | 0 | 0 | 0 |
| 287 | 0 | 6 | 11 | 56 |
| 316 | 0 | 1 | 0 | 1 |
| 317 | 0 | 1 | 0 | 0 |
| 331 | 0 | 0 | 0 | 0 |
| 335 | 0 | 0 | 0 | 1 |
| 336 | 0 | 0 | 0 | 0 |
| 338 | 0 | 0 | 0 | 1 |
| 340 | 0 | 2 | 0 | 0 |
| 341 | 0 | 0 | 0 | 0 |
| 343 | 0 | 1 | 0 | 0 |
| 347 | 0 | 0 | 0 | 0 |
| 349 | 0 | 0 | 0 | 0 |
| 351 | 0 | 0 | 0 | 0 |
| 353 | 0 | 0 | 0 | 0 |
| 355 | 0 | 0 | 0 | 0 |
| 357 | 0 | 0 | 0 | 0 |
| 359 | 0 | 0 | 0 | 0 |
| 413 | 5 | 3 | 3 | 3 |
| 414 | 3 | 3 | 2 | 2 |
| 415 | 4 | 4 | 2 | 2 |

Example 14 p53 GRIP Assay

Thermo Scientific* BioImage p53-MDM2 Redistribution Assay monitors the protein interaction with MDM2 and cellular translocation of GFP-tagged p53 in response to drug compounds or other stimuli. Recombinant CHO-hIR cells stably express human p53(1-312) fused to the C-terminus of enhanced green fluorescent protein (EGFP) and PDE4A4-MDM2(1-124), a fusion protein between PDE4A4 and MDM2(1-124). They provide a ready-to-use assay system for measuring the effects of experimental conditions on the interaction of p53 and MDM2. Imaging and analysis is performed with a HCS platform.

CHO-hIR cells are regularly maintained in Ham's F12 media supplemented with 1% Penicillin-Streptomycin, 0.5 mg/ml Geneticin, 1 mg/ml Zeocin and 10% FBS. Cells seeded into 96-well plates at the density of 7000 cells/100 μl per well 18-24 hours prior to running the assay using culture media. The next day, media is refreshed and PD177 is added to cells to the final concentration of 3 μM to activate foci formation. Control wells are kept without PD-177 solution. 24 h post stimulation with PD177, cells are washed once with Opti-MEM Media and 50 μL at of the Opti-MEM Media supplemented with PD-177 (6 μM) is added to cells. Peptides are diluted from 10 mM DMSO stocks to 500 μM working stocks in sterile water, further dilutions made in 0.5% DMSO to keep the concentration of DMSO constant across the samples. Final highest DMSO concentration is 0.5% and is used as the negative control. Cayman Chemicals Cell-Based Assay (–)-Nutlin-3 (10 mM) is used as positive control. Nutlin was diluted using the same dilution scheme as peptides. 50 µl of 2× desired concentrations is added to the appropriate well to achieve the final desired concentrations. Cells are then incubated with peptides for 6 h at 37° C. in humidified 5% CO2 atmosphere. Post-incubation period, cells are fixed by gently aspirating out the media and adding 150 µl of fixing solution per well for 20 minutes at room temperature. Fixed cells are washed 4 times with 200 µl PBS per well each time. At the end of last wash, 100 µl of 1 µM Hoechst staining solution is added. Sealed plates incubated for at least 30 min in dark, washed with PBS to remove excess stain and PBS is added to each well. Plates can be stored at 4° C. in dark up to 3 days. The translocation of p53/MDM2 is imaged using Molecular translocation module on Cellomics Arrayscan instrument using 10× objective, XF-100 filter sets for Hoechst and GFP. The output parameters was Mean-CircRINGAveIntenRatio (the ratio of average fluorescence intensities of nucleus and cytoplasm, (well average)). The minimally acceptable number of cells per well used for image analysis was set to 500 cells.

Example 15

MCF-7 Breast Cancer Study Using SP315, SP249 and SP154

A xenograft study was performed to test the efficacy of SP315, SP249 and SP154 in inhibiting tumor growth in athymic mice in the MCF-7 breast cancer xenograft model. A negative control stapled peptide. SP252, a point mutation of SP154 (F to A at position 19) was also tested in one group; this peptide had shown no activity in the SJSA-1 in vitro viability assay. Slow release 90 day 0.72 mg 17β-estradiol pellets (Innovative Research, Sarasota, Fla.) were implanted subcutaneously (sc) on the nape of the neck one day prior to tumor cell implantation (Day −1). On Day 0, MCF-7 tumor cells were implanted sc in the flank of female nude (Crl: NU-Foxn1nu) mice. On Day 18, the resultant sc tumors were measured using calipers to determine their length and width and the mice were weighed. The tumor sizes were calculated using the formula (length×width$^2$)/2 and expressed as cubic millimeters (mm$^3$) Mice with tumors smaller than 85.3 mm$^3$ or larger than 417.4 mm$^3$ were excluded from the subsequent group formation. Thirteen groups of mice, 10 mice per group, were formed by randomization such that the group mean tumor sizes were essentially equivalent (mean of groups±standard deviation of groups=180.7±17.5 mm$^3$).

SP315, SP249, SP154 and SP252 dosing solutions were prepared from peptides formulated in a vehicle containing MPEG(2K)-DSPE at 50 mg/mL concentration in a 10 mM Histidine buffered saline at pH 7. This formulation was prepared once for the duration of the study. This vehicle was used as the vehicle control in the subsequent study.

Each group was assigned to a different treatment regimen. Group 1, as the vehicle negative control group, received the vehicle administered at 8 mL/kg body weight intravenously (iv) three times per week from Days 18-39. Groups 2 and 3 received SP154 as an iv injection at 30 mg/kg three times per week or 40 mg/kg twice a week, respectively. Group 4 received 6.7 mg/kg SP249 as an iv injection three times per week. Groups 5, 6, 7 and 8 received SP315 as an iv injection of 26.7 mg/kg three times per week, 20 mg/kg twice per week, 30 mg/kg twice per week, or 40 mg/kg twice per week, respectively. Group 9 received 30 mg/kg SP252 as an iv injection three times per week.

During the dosing period the mice were weighed and tumors measured 1-2 times per week. Results in terms of tumor volume are shown in FIGS. 3-6 and tumor growth inhibition compared with the vehicle group, body weight change and number of mice with ≥20% body weight loss or death are shown in Table 9. Tumor growth inhibition (TGI) was calculated as % TGI=100−[(TuVol$^{Treated-day\ x}$−TuVol$^{Treated-day18}$)/(TuVol$^{Vehicle\ negative\ control-day\ x}$−TuVol$^{Vehicle\ negative\ control-day18}$)]*100, where x=day that effect of treatment is being assessed. Group 1, the vehicle negative control group, showed good tumor growth rate for this tumor model.

For SP154, in the group dosed with 40 mg/kg twice a week 2 mice died during treatment, indicating that this dosing regimen was not tolerable. The dosing regimen of 30 mg/kg of SP154 three times per week was well-tolerated and yielded a TGI of 84%.

For SP249, the group dosed with 6.7 mg/kg three times per week 4 mice died during treatment, indicating that this dosing regimen was not tolerable.

All dosing regimens used for SP315 showed good tolerability, with no body weight loss or deaths noted. Dosing with 40 mg/kg of SP315 twice per week produced the highest TGI (92%). The dosing regimens of SP315 of 26.7 mg/kg three times per week, 20 mg/kg twice per week, 30 mg/kg twice per week produced TGI of 86, 82, and 85%, respectively.

For SP252, the point mutation of SP154 which shows no appreciable activity in in vitro assays, dosing with 30 mg/kg three times per week was well-tolerated with no body weight loss or deaths noted. While TGI of 88% was noted by Day 32, that TGI was reduced to 41% by Day 39.

Results from this Example are shown in FIGS. 3-6 and are summarized in Table 9.

TABLE 9

| Group Number | Treatment Group | % BW Change | No. with ≥10% BW Loss | No. with ≥20% BW Loss or death | % TGI |
|---|---|---|---|---|---|
| 1 | Vehicle | +8.6 | 0/10 | 0/10 | — |
| 2 | SP154 30 mg/kg 3x/wk iv | +5.7 | 0/10 | 0/10 | *84 |
| 3 | SP154 40 mg/kg 2x/wk iv | N/A | 0/10 | 2/10 (2 deaths) | Regimen not tolerated |
| 4 | SP249 6.7 mg/kg 3x/wk iv | N/A | 6/10 | 4/10 | Regimen not tolerated |
| 5 | SP315 26.7 mg/kg 3x/wk iv | +3.7 | 0/10 | 0/10 | *86 |
| 6 | SP315 20 mg/kg 2x/wk iv | +3.9 | 0/10 | 0/10 | *82 |
| 7 | SP315 30 mg/kg 2x/wk iv | +8.0 | 0/10 | 0/10 | *85 |
| 8 | SP315 40 mg/kg 2x/wk iv | +2.1 | 0/10 | 0/10 | *92 |
| 9 | SP252 30 mg/kg 3x/wk iv | +3.3 | 0/10 | 0/10 | *41 |

*p ≤ 0.05 Vs Vehicle Control

Example 16

Solubility Determination for Peptidomimetic Macrocycles

Peptidomimetic macrocycles are first dissolved in neat N,N-dimethylacetamide (DMA, Sigma-Aldrich, 38840-1L-F) to make 20× stock solutions over a concentration range of 20-140 mg/mL. The DMA stock solutions are diluted 20-fold in an aqueous vehicle containing 2% Solutol-HS-15, 25 mM Histidine, 45 mg/mL Mannitol to obtain final concentrations of 1-7 mg/ml of the peptidomimetic macrocycles in 5% DMA, 2% Solutol-HS-15, 25 mM Histidine, 45 mg/mL Mannitol. The final solutions are mixed gently by repeat pipetting or light vortexing, and then the final solutions are sonicated for 10 min at room temperature in an ultrasonic water bath. Careful visual observation is then performed under hood light using a 7× visual amplifier to determine if precipitate exists on the bottom or as a suspension. Additional concentration ranges are tested as needed to determine the maximum solubility limit for each peptidomimetic macrocycle.

Figure 7:
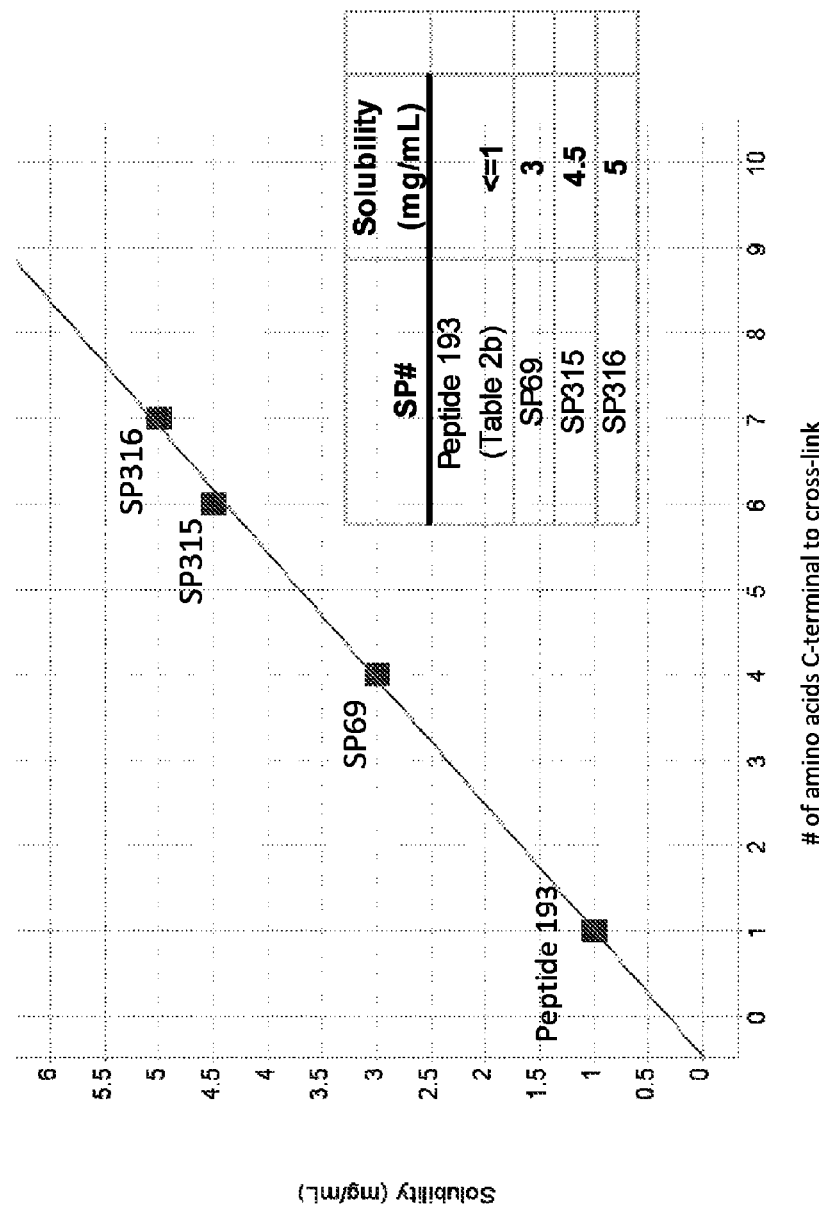
FIG. 7 shows a plot of solubility for peptidomimetic macrocycles with varying C-terminal extensions.

Results from this Example are shown in FIG. 7.

Example 17

Preparation of Peptidomimetic Macrocycles Using a Boc-Protected Amino Acid

Peptidomimetic macrocycle precursors were prepared as described in Example 2 comprising an R8 amino acid at position "i" and an S5 amino acid at position "i+7". The amino acid at position "i+3" was a Boc-protected tryptophan which was incorporated during solid-phase synthesis. Specifically, the Boc-protected tryptophan amino acid shown below (and commercially available, for example, from Novabiochem) was using during solid phase synthesis:

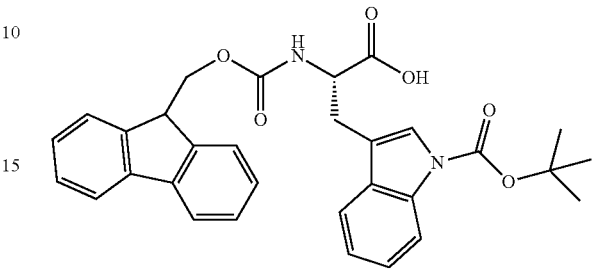

Metathesis was performed using a ruthenium catalyst prior to the cleavage and deprotection steps. The composition obtained following cyclization was determined by HPLC analysis to contain primarily peptidomimetic macrocycles having a crosslinker comprising a trans olefin ("iso2", comprising the double bond in an E configuration). Unexpectedly, a ratio of 90:10 was observed for the trans and cis products, respectively.

---

SEQUENCE LISTING (1502 sequences)

SEQ ID NO: 1 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 2 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 3 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising one double bond
  misc_feature (1)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
ASQQTFSALWRLLXQN

SEQ ID NO: 4 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon i to i+7 crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSNLWALLXQN

SEQ ID NO: 5 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 6 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 7 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 8 - protein, 10 aa, Artificial Sequence
  Description of Artificial Sequence: Synthetic peptide
  MOD_RES (2)..(2): Any amino acid
  MOD_RES (9)..(9): Any amino acid
  see specification as filed for detailed description of substitutions and preferred embodiments
FXHYWAQLXS

SEQ ID NO: 9 - protein, 10 aa, Artificial Sequence
  Description of Artificial Sequence: Synthetic peptide
  MOD_RES (2)..(2): Any amino acid
  MOD_RES (8)..(8): Leu or Cba
  MOD_RES (9)..(9): Any amino acid
  see specification as filed for detailed description of substitutions and preferred embodiments
FXEYWAQXXA

SEQ ID NO: 10 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAA

SEQ ID NO: 11 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAXA

SEQ ID NO: 12 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLASAL

SEQ ID NO: 13 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAL

SEQ ID NO: 14 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAM

SEQ ID NO: 15 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hLeu
  C-term NH2
LTFAAYWAQLASAL

SEQ ID NO: 16 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 17 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAI

SEQ ID NO: 18 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Cyclohexyl-Gly
  C-term NH2
LTFAAYWAQLASAG

SEQ ID NO: 19 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLASAX

SEQ ID NO: 20 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 21 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  MOD_RES (14)..(14): Norleucine
  C-term NH2
LTFAAYWAALASAL

SEQ ID NO: 22 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): Alpha-Me S5-pentenyl-alanine olefin amino acid connected by an all-carbon crosslinker comprising one double bond
  misc_feature (11)..(13): Crosslink between residues
  MOD_RES (13)..(13): Alpha-Me S5-pentenyl-alanine olefin amino acid connected by an all-carbon crosslinker comprising one double bond
  C-term NH2
LTFAAYWAALASAA

SEQ ID NO: 23 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEXLAAAL

SEQ ID NO: 24 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAL

SEQ ID NO: 25 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAM

SEQ ID NO: 26 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): hLeu
  C-term NH2
FAAYWEXLAAAL

SEQ ID NO: 27 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAF

SEQ ID NO: 28 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAAI

SEQ ID NO: 29 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  C-term NH2
FAAYWEXLAAAG

SEQ ID NO: 30 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): Cyclohexyl-Ala
  C-term NH2
FAAYWEXLAAAA

SEQ ID NO: 31 - protein, 12 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAAYWEXLAAAX

SEQ ID NO: 32 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 33 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXV

SEQ ID NO: 34 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 35 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  C-term NH2
LTFAAYWAQLASXAA

SEQ ID NO: 36 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(16): Norleucine
  C-term NH2
HLTFAHHWHQLAAALL

SEQ ID NO: 37 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
DLTFAHHWHQLARRLV

SEQ ID NO: 38 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HHTFAHHWHQLAAAML

SEQ ID NO: 39 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLARRDA

SEQ ID NO: 40 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLAHRFV

SEQ ID NO: 41 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): hLeu
  C-term NH2
HLTFAHHWHQLAAALA

SEQ ID NO: 42 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 43 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Gly
  MOD_RES (16)..(16): D-amino acid
  C-term NH2
DLTFAHHWHQLARRGL

SEQ ID NO: 44 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Cyclohexyl-Ala
  MOD_RES (16)..(16): D-amino acid
  C-term NH2
HHTFAHHWHQLAAAAV

SEQ ID NO: 45 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAHHWHQLARRDA

SEQ ID NO: 46 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): 2-aminoisobutyric acid
  C-term NH2
FAHHWHQLAHRXG

SEQ ID NO: 47 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWAQLAHHLL

SEQ ID NO: 48 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Norleucine
  C-term NH2
FAAYWSALAHQAL

SEQ ID NO: 49 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Cyclohexyl-Gly
  MOD_RES (13)..(13): D-amino acid
  C-term NH2
FAAYWVQLAQHGL

SEQ ID NO: 50 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWTALAQQLV

SEQ ID NO: 51 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  MOD_RES (13)..(13): D-amino acid
  C-term NH2
FAAYWYQLAHXAA

SEQ ID NO: 52 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 53 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAHHLA

SEQ ID NO: 54 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 55 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAHQLV

SEQ ID NO: 56 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 57 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAQQML

SEQ ID NO: 58 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): hLeu
  C-term NH2
LTFAAYWAQLAHXLV

SEQ ID NO: 59 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAHFA

SEQ ID NO: 60 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  MOD_RES (16)..(16): D-amino acid
  C-term NH2
HLTFAHHWHQLAAALL

SEQ ID NO: 61 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
DLTFAHHWHQLARRLA

SEQ ID NO: 62 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
HHTFAHHWHQLAAAMV

SEQ ID NO: 63 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHHWHQLARRDA

SEQ ID NO: 64 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): Cyclohexyl-Ala
  C-term NH2
FAHHWHQLAHRFA

SEQ ID NO: 65 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHAm
FAAYWEALAAA

SEQ ID NO: 66 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHiAm
FAAYWEALAAA

SEQ ID NO: 67 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr3Ph
FAAYWEALAAA

SEQ ID NO: 68 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnBu33Me
FAAYWEALAAA

SEQ ID NO: 69 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnPr
FAAYWEALAAA

SEQ ID NO: 70 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Ch
FAAYWEALAAA

SEQ ID NO: 71 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHnEt2Cp
FAAYWEALAAA

SEQ ID NO: 72 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NHHex
FAAYWEALAAA

SEQ ID NO: 73 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 74 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAAIA

SEQ ID NO: 75 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 76 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAAMA

SEQ ID NO: 77 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 78 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 79 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 80 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 81 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 82 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAMA

SEQ ID NO: 83 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 84 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALA

SEQ ID NO: 85 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 86 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIV

SEQ ID NO: 87 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAMV

SEQ ID NO: 88 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 89 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAALAAALV

SEQ ID NO: 90 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 91 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAIL

SEQ ID NO: 92 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAML

SEQ ID NO: 93 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 94 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAAYWAQLAAALL

SEQ ID NO: 95 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAAMA

SEQ ID NO: 96 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  C-term NH2
FAAYWEALAAALA

SEQ ID NO: 97 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIA

SEQ ID NO: 98 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMA

SEQ ID NO: 99 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALA

SEQ ID NO: 100 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIV

SEQ ID NO: 101 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAMV

SEQ ID NO: 102 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALV

SEQ ID NO: 103 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAIL

SEQ ID NO: 104 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (13)..(13): D-amino acid
  C-term NH2
FAAYWEALAAAML

SEQ ID NO: 105 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 106 - protein, 13 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (12)..(12): Norleucine
  MOD_RES (13)..(13): D-amino acid
  C-term NH2
FAAYWEALAAALL

SEQ ID NO: 107 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 108 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 109 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 110 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLAAVAA

SEQ ID NO: 111 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 112 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAAVA

SEQ ID NO: 113 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 114 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
WTFAFYWSQLASAAA

SEQ ID NO: 115 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 116 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(16): D-amino acid
  C-term NH2
WTFAVYWSQLAAVAAA

SEQ ID NO: 117 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 118 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVG

SEQ ID NO: 119 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 120 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAVQ

SEQ ID NO: 121 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 122 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAAYWAQLASAA

SEQ ID NO: 123 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 124 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 125 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(14): Crosslink between residues
  MOD_RES (11)..(11): Two pentenyl-alanine olefin side chains, each of which is crosslinked to another amino acid as indicated
  MOD_RES (14)..(14): Alpha-Me S5-pentenyl-alanine olefin amino acid connected by an all-carbon crosslinker comprising one double bond
  C-term NH2
LTFAAYWEQLASAA

SEQ ID NO: 126 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 127 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASLA

SEQ ID NO: 128 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 129 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASWA

SEQ ID NO: 130 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVS

SEQ ID NO: 131 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASAS

SEQ ID NO: 132 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASVG

SEQ ID NO: 133 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASAA

SEQ ID NO: 134 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAA

SEQ ID NO: 135 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVA

SEQ ID NO: 136 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASLA

SEQ ID NO: 137 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASWA

SEQ ID NO: 138 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAKYWAQLASWA

SEQ ID NO: 139 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVS

SEQ ID NO: 140 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASAS

SEQ ID NO: 141 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAVYWAQLASVG

SEQ ID NO: 142 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASSA

SEQ ID NO: 143 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASSA

SEQ ID NO: 144 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASNA

SEQ ID NO: 145 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
ETFAVYWAQLASNA

SEQ ID NO: 146 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAVYWAQLASAA

SEQ ID NO: 147 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 148 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVA

SEQ ID NO: 149 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASWA

SEQ ID NO: 150 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 151 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVS

SEQ ID NO: 152 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 153 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASAS

SEQ ID NO: 154 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 155 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLASVG

SEQ ID NO: 156 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 157 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 158 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 159 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAEYWAQGASAA

SEQ ID NO: 160 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 161 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQFASAA

SEQ ID NO: 162 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 163 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 164 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 165 - protein, 14 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 166 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 167 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 168 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 169 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 170 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLASAA

SEQ ID NO: 171 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLASAA

SEQ ID NO: 172 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLASAA

SEQ ID NO: 173 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 174 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 175 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAQLASAA

SEQ ID NO: 176 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAQLASAA

SEQ ID NO: 177 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 178 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 179 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAAIA

SEQ ID NO: 180 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWAQLAAAIA

SEQ ID NO: 181 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 182 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWAQLAAAIA

SEQ ID NO: 183 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 184 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWAQLAAAIA

SEQ ID NO: 185 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWVQLAAAIA

SEQ ID NO: 186 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAFYWVQLAAAIA

SEQ ID NO: 187 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEYWVQLAAAIA

SEQ ID NO: 188 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ITFAEHWVQLAAAIA

SEQ ID NO: 189 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAEWAQLAAAIA

SEQ ID NO: 190 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 191 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQLAAAIA

SEQ ID NO: 192 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAAHFA

SEQ ID NO: 193 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 194 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAAHFA

SEQ ID NO: 195 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 196 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFHWAQLAAEFA

SEQ ID NO: 197 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 198 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAAHFA

SEQ ID NO: 199 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWVQLAAHFA

SEQ ID NO: 200 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWVQLAAHFA

SEQ ID NO: 201 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWVQLAAHFA

SEQ ID NO: 202 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 203 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAAHFA

SEQ ID NO: 204 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAALASAA

SEQ ID NO: 205 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVALASAA

SEQ ID NO: 206 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAALASAA

SEQ ID NO: 207 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 208 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAEWAALASAA

SEQ ID NO: 209 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 210 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAASWAALASAA

SEQ ID NO: 211 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 212 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAALAAAIA

SEQ ID NO: 213 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAAHFA

SEQ ID NO: 214 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 215 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAHIA

SEQ ID NO: 216 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAHWAQLAAHIA

SEQ ID NO: 217 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAHIA

SEQ ID NO: 218 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 219 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAFA

SEQ ID NO: 220 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAWA

SEQ ID NO: 221 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 222 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAVA

SEQ ID NO: 223 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 224 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAALA

SEQ ID NO: 225 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 226 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAIA

SEQ ID NO: 227 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 228 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAFA

SEQ ID NO: 229 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 230 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAVA

SEQ ID NO: 231 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 232 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAIA

SEQ ID NO: 233 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 234 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAAWA

SEQ ID NO: 235 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 236 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEHWAQLAAALA

SEQ ID NO: 237 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
ETFAEHWVQLAAALA

SEQ ID NO: 238 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 239 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQLAAAAA

SEQ ID NO: 240 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 241 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
LTFAAYWAQLAAAXA

SEQ ID NO: 242 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 243 - protein, 15 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (15)..(15): D-amino acid
  C-term NH2
LTFAAYWAQLAAAIA

SEQ ID NO: 244 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAQLASAA

SEQ ID NO: 245 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 246 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAALA

SEQ ID NO: 247 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALA

SEQ ID NO: 248 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAWLA

SEQ ID NO: 249 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ETFAAYWAQAAAWLA

SEQ ID NO: 250 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAWLA

SEQ ID NO: 251 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAFA

SEQ ID NO: 252 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAASALA

SEQ ID NO: 253 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 254 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWSQAASALA

SEQ ID NO: 255 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWWQAASALA

SEQ ID NO: 256 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 257 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 258 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 259 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
ETFAEYWAQAASAA

SEQ ID NO: 260 - protein, 14 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 261 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWAQAASAA

SEQ ID NO: 262 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 263 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAAQAASAA

SEQ ID NO: 264 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAA

SEQ ID NO: 265 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 266 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAFA

SEQ ID NO: 267 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 268 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAASAF

SEQ ID NO: 269 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAFWAQAASAF

SEQ ID NO: 270 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAF

SEQ ID NO: 271 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWSQAASAF

SEQ ID NO: 272 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWWQAASAF

SEQ ID NO: 273 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 274 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 275 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAAAAIA

SEQ ID NO: 276 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAFWAQAAAAIA

SEQ ID NO: 277 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 278 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAFA

SEQ ID NO: 279 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQAAAWLA

SEQ ID NO: 280 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQAAAWLA

SEQ ID NO: 281 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 282 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQAAAWLA

SEQ ID NO: 283 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 284 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAAYWAQAASAFA

SEQ ID NO: 285 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAAYWAQLAAWLA

SEQ ID NO: 286 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
LTFAEYWAQLAAWLA

SEQ ID NO: 287 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): D-amino acid
  C-term NH2
ETFAEYWAQLAAWLA

SEQ ID NO: 288 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 289 - protein, 14 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 290 - protein, 14 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 291 - protein, 14 aa, Artificial Sequence
  Description of Artificial Sequence: Synthetic peptide
  N-term Decac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 292 - protein, 14 aa, Artificial Sequence
  Description of Artificial Sequence: Synthetic peptide
  N-term Admac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 293 - protein, 14 aa, Artificial Sequence
  Description of Artificial Sequence: Synthetic peptide
  N-term Tmac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 294 - protein, 14 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 295 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALA

SEQ ID NO: 296 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAAAAIA

SEQ ID NO: 297 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 298 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 299 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 300 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 301 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 302 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWSQAASAA

SEQ ID NO: 303 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 304 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 305 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAF

SEQ ID NO: 306 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 307 - protein, 14 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLASAA

SEQ ID NO: 308 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 309 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAFWAQLASAA

SEQ ID NO: 310 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 311 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWSQLASAA

SEQ ID NO: 312 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 313 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 314 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 315 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 316 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 317 - protein, 15 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 318 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 319 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAFWAQLAAALA

SEQ ID NO: 320 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 321 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWSQLAAALA

SEQ ID NO: 322 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 323 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAAYWAQLAAAAAA

SEQ ID NO: 324 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 325 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 326 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAAYWAQLAAAAAAAA

SEQ ID NO: 327 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALA

SEQ ID NO: 328 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAAYWAQLAAALA

SEQ ID NO: 329 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 330 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALAA

SEQ ID NO: 331 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQAAAALAA

SEQ ID NO: 332 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALAA

SEQ ID NO: 333 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 334 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAA

SEQ ID NO: 335 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 336 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAAAA

SEQ ID NO: 337 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 338 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAAA

SEQ ID NO: 339 - protein, 15 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 340 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 341 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 342 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 343 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 344 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 345 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (7)..(7): 6cl-Trp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 346 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 347 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 348 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(4): Crosslink between residues
  MOD_RES (5)..(5): 6cl-Trp
  MOD_RES (16)..(16): D-amino acid
  C-term NH2
FAAYWEALAAAAAAAA

SEQ ID NO: 349 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 350 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
ETFAEYWAQLAAAAAAA

SEQ ID NO: 351 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 352 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (18)..(18): D-amino acid
  C-term NH2
LTFAEYWAQLAAAAAAAA

SEQ ID NO: 353 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 354 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAAYWAQLAAALAAA

SEQ ID NO: 355 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 356 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 357 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 358 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 359 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 360 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWSQAAAAAAAA

SEQ ID NO: 361 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 362 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQAASAAA

SEQ ID NO: 363 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 364 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (16)..(16): D-amino acid
  C-term NH2
ALTFAEYWAQAASAAA

SEQ ID NO: 365 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 366 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  MOD_RES (17)..(17): D-amino acid
  C-term NH2
ALTFAEYWAQAASAAAA

SEQ ID NO: 367 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 368 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): Cyclobutyl-Ala
  MOD_RES (13)..(13): Alpha-Me S5-pentenyl-alanine olefin amino acid connected by an all-carbon crosslinker comprising one double bond
  MOD_RES (18)..(18): D-amino acid
  C-term NH2
AALTFAEYWAQAASAAAA

SEQ ID NO: 369 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
RTFAEYWAQAASAA

SEQ ID NO: 370 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LRFAEYWAQAASAA

SEQ ID NO: 371 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWRQAASAA

SEQ ID NO: 372 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWARAASAA

SEQ ID NO: 373 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAARAA

SEQ ID NO: 374 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASRA

SEQ ID NO: 375 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAR

SEQ ID NO: 376 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 377 - protein, 16 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAAYWAQLAAALA

SEQ ID NO: 378 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LAFAEYWAQLAAALA

SEQ ID NO: 379 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
ATFAEYWAQLAAALA

SEQ ID NO: 380 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
AAFAEYWAQLAAALA

SEQ ID NO: 381 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AAAFAEYWAQLAAALA

SEQ ID NO: 382 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AAAAFAEYWAQLAAALA

SEQ ID NO: 383 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
AATFAEYWAQLAAALA

SEQ ID NO: 384 - protein, 17 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALA

SEQ ID NO: 385 - protein, 18 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (17)..(17): Norleucine
  C-term NH2
AAALTFAEYWAQLAAALA

SEQ ID NO: 386 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 387 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 388 - protein, 18 aa, Artificial Sequence
  Description of Artificial Sequence: Synthetic peptide
  N-term Ac
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  MOD_RES (16)..(16): Norleucine
  C-term NH2
AALTFAEYWAQLAAALAA

SEQ ID NO: 389 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQAAAALAA

SEQ ID NO: 390 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEYWAQLAAALAA

SEQ ID NO: 391 - protein, 17 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): hLeu
  MOD_RES (12)..(12): Alpha-Me S5-pentenyl-alanine olefin amino acid connected by an all-carbon crosslinker comprising one double bond
  MOD_RES (15)..(15): Norleucine
  C-term NH2
ALTFAEYWAQLAAALAA

SEQ ID NO: 392 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 393 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): N-methyl-Tyr
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 394 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 395 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): N-methyl-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 396 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 397 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): Alpha-Me-Trp
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 398 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 399 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 400 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 401 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (14)..(14): Norleucine
  C-term NH2
LTFAAYWAQLAAXLA

SEQ ID NO: 402 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 403 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (14)..(14): Norleucine
  C-term NH2
LTFAAYWAQLAAALA

SEQ ID NO: 404 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 405 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (14)..(14): Norleucine
  C-term NH2
LTFAAYWAQLAAXLA

SEQ ID NO: 406 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 407 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): 2-aminoisobutyric acid
  C-term NH2
LTFAAYWAQLAAALX

SEQ ID NO: 408 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 409 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): N-methyl-Ala
  C-term NH2
LTFAAYWAQLAAALA

SEQ ID NO: 410 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 411 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (15)..(15): Sarcosine
  C-term NH2
LTFAAYWAQLAAALX

SEQ ID NO: 412 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 413 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): 2-aminoisobutyric acid
  C-term NH2
LTFAAYWAQLAAALAX

SEQ ID NO: 414 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 415 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): N-methyl-Ala
  C-term NH2
LTFAAYWAQLAAALAA

SEQ ID NO: 416 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 417 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): D-amino acid
  C-term NH2
LTFAAYWAQLAAALAA

SEQ ID NO: 418 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 419 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (16)..(16): Sarcosine
  C-term NH2
LTFAAYWAQLAAALAX

SEQ ID NO: 420 - protein, 15 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): Norleucine
  C-term NH2
LTFAAYWAQLAAALA

SEQ ID NO: 421 - protein, 15 aa, Artificial Sequence
  Description of Artificial Sequence: Synthetic peptide
  N-term Ac
  MOD_RES (4)..(4): 2-aminoisobutyric acid
  MOD_RES (11)..(11): 2-aminoisobutyric acid
  MOD_RES (14)..(14): Norleucine
  C-term NH2
LTFXAYWAQLXAALA

SEQ ID NO: 422 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 423 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAXYWAQLAAALA

SEQ ID NO: 424 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWXQLAAALA

SEQ ID NO: 425 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 426 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Cou4
  MOD_RES (14)..(14): Norleucine
  C-term NH2
LTFAAYWAQLAXALA

SEQ ID NO: 427 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 428 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Cou4
  MOD_RES (14)..(14): Norleucine
  C-term NH2
LTFAAYWAQLAAXLA

SEQ ID NO: 429 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 430 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term OH
LTFAAYWAQLAAALA

SEQ ID NO: 431 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 432 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnPr
LTFAAYWAQLAAALA

SEQ ID NO: 433 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 434 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHnBu33Me
LTFAAYWAQLAAALA

SEQ ID NO: 435 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 436 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NHHex
LTFAAYWAQLAAALA

SEQ ID NO: 437 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTAAAYWAQLAAALA

SEQ ID NO: 438 - protein, 15 aa, Artificial Sequence
  Description of Artificial Sequence: Synthetic peptide
  N-term Ac
  MOD_RES (3)..(3): hLeu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTLAAYWAQLAAALA

SEQ ID NO: 439 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 440 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYAAQLAAALA

SEQ ID NO: 441 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou4
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 442 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWXQAASAA

SEQ ID NO: 443 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon saturated crosslinker comprising no double bonds
  C-term NH2
LTFAEYWAQAASAA

SEQ ID NO: 444 - protein, 14 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 445 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 446 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 447 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 448 - protein, 17 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 449 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 450 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEFWAQAAAAIA

SEQ ID NO: 451 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 452 - protein, 15 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAAYWAQLAAALA

SEQ ID NO: 453 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (14)..(14): Norleucine
  C-term NH2
LTFAAYWAQLAAALA

SEQ ID NO: 454 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  MOD_RES (17)..(17): D-amino acid
  C-term NH2
LTFAEYWAQLAAAAAAA

SEQ ID NO: 455 - protein, 16 aa, Artificial Sequence
  Description of Artificial Sequence: Synthetic peptide
  MOD_RES (1)..(1): Cou6
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 456 - protein, 16 aa, Artificial Sequence
  Description of Artificial Sequence: Synthetic peptide
  MOD_RES (1)..(1): Cou8
  MOD_RES (2)..(2): Beta-Ala
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (12)..(12): hLeu
  MOD_RES (13)..(13): Alpha-Me S5-pentenyl-alanine olefin amino acid connected by an all-carbon crosslinker comprising one double bond
  C-term NH2
XALTFAEYWAQLASAA

SEQ ID NO: 457 - protein, 17 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 458 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 459 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 460 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 461 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 462 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAELAAAAAAA

SEQ ID NO: 463 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAELAAAAAAA

SEQ ID NO: 464 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 465 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQLAAAAAAA

SEQ ID NO: 466 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 467 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 468 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
RTFAEYWAQLAAAAAAA

SEQ ID NO: 469 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYWAQLAAAAAAA

SEQ ID NO: 470 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 471 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 472 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  MOD_RES (17)..(17): D-amino acid
  C-term NH2
LTFAEYWAQLAAAXAAA

SEQ ID NO: 473 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 474 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 475 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 476 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 477 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  MOD_RES (17)..(17): D-amino acid
  C-term NH2
LTFAEYWAQLAAAAAAA

SEQ ID NO: 478 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  MOD_RES (17)..(17): D-amino acid
  C-term NH2
LTFAEYWAQLAAAAAAA

SEQ ID NO: 479 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 480 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  MOD_RES (17)..(17): D-amino acid
  C-term NH2
LTFAEYWAQLAAAAAAA

SEQ ID NO: 481 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 482 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 483 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Sarcosine
  MOD_RES (17)..(17): D-amino acid
  C-term NH2
LTFAEYWAQLAAXAAAA

SEQ ID NO: 484 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Sarcosine
  MOD_RES (17)..(17): D-amino acid
  C-term NH2
LTFAEYWAQLAAAXAAA

SEQ ID NO: 485 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Sarcosine
  MOD_RES (17)..(17): D-amino acid
  C-term NH2
LTFAEYWAQLAAAAXAA

SEQ ID NO: 486 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): Sarcosine
  MOD_RES (17)..(17): D-amino acid
  C-term NH2
LTFAEYWAQLAAAAAXA

SEQ ID NO: 487 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 488 - protein, 17 aa, Artificial Sequence
  Description of Artificial Sequence: Synthetic peptide
  N-term Ac
  MOD_RES (1)..(1): N15 isotopic-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 489 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 490 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 491 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 492 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 493 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 494 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 495 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 496 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 497 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 498 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAA

SEQ ID NO: 499 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAA

SEQ ID NO: 500 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAA

SEQ ID NO: 501 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAASAA

SEQ ID NO: 502 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWAQAAS

SEQ ID NO: 503 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAS

SEQ ID NO: 504 - protein, 17 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 505 - protein, 14 aa, Artificial Sequence
  Description of Artificial Sequence: Synthetic peptide
  N-term 4FBzl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 506 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 507 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAHYWAQLAAAAAAA

SEQ ID NO: 508 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAQYWAQLAAAAAAA

SEQ ID NO: 509 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAXYWAQLAAAAAAA

SEQ ID NO: 510 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(13): Crosslink between residues
  MOD_RES (6)..(7): D-amino acid
  MOD_RES (13)..(13): Alpha-Me S5-pentenyl-alanine olefin amino acid connected by an all-carbon crosslinker comprising one double bond
  MOD_RES (19)..(19): D-amino acid
  C-term NH2
LTFAELAYWAQLAAAAAAA

SEQ ID NO: 511 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (5)..(5): Phe-4
  MOD_RES (6)..(6): D-amino acid
  MOD_RES (12)..(121): Alpha-Me S5-pentenyl-alanine olefin amino acid connected by an all-carbon crosslinker comprising one double bond
  MOD_RES (18)..(18): D-amino acid
  C-term NH2
LTFAFGYWAQLAAAAAAA

SEQ ID NO: 512 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2m-Arg
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFARYWAQLAAAAAAA

SEQ ID NO: 513 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): ip-Lys
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAKYWAQLAAAAAAA

SEQ ID NO: 514 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Phe-4NH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAFYWAQLAAAAAAA

SEQ ID NO: 515 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAALAAAAAAA

SEQ ID NO: 516 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWALLAAAAAAA

SEQ ID NO: 517 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): 2-aminoisobutyric acid
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 518 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWASLAAAAAAA

SEQ ID NO: 519 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWANLAAAAAAA

SEQ ID NO: 520 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Cit
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAXLAAAAAAA

SEQ ID NO: 521 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAHLAAAAAAA

SEQ ID NO: 522 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWARLAAAAAAA

SEQ ID NO: 523 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (6)..(6): pTyr
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 524 - protein, 14 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 525 - protein, 17 aa, Artificial Sequence
  Description of Artificial Sequence: Synthetic peptide
  N-term Cbm
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 526 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAAAA

SEQ ID NO: 527 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 528 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLASAAASA

SEQ ID NO: 529 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (11)..(11): Beta-Ala
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
LTFAEYWAQTAAAAAAAA

SEQ ID NO: 530 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQGAAAAAAA

SEQ ID NO: 531 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 532 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 533 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 534 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQFAAAAAAA

SEQ ID NO: 535 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQLAAALAAA

SEQ ID NO: 536 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  MOD_RES (14)..(14): Norleucine
  MOD_RES (17)..(17): D-amino acid
  C-term NH2
LTFAEYWAQGAAALAAA

SEQ ID NO: 537 - protein, 18 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 538 - protein, 15 aa, Artificial Sequence
  Description of Artificial Sequence: Synthetic peptide
  N-term 4FBz
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 539 - protein, 17 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 540 - protein, 14 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S8-octenyl-alanine olefin amino acid connected by an all-carbon crosslinker comprising one double bond
  C-term NH2
LTFAEYWAQAASAA

SEQ ID NO: 541 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): hhLeu
  MOD_RES (17)..(17): D-amino acid
  C-term NH2
LTFAEYWAQLAAALAAA

SEQ ID NO: 542 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (19)..(19): D-amino acid
  C-term NH2
LTFAEYWAQLAAAAAAAAA

SEQ ID NO: 543 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (20)..(20): D-amino acid
  C-term NH2
LTFAEYWAQLAAAAAAAAAA

SEQ ID NO: 544 - protein, 21 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (21)..(21): D-amino acid
  C-term NH2
LTFAEYWAQLAAAAAAAAAAA

SEQ ID NO: 545 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAAQAASAA

SEQ ID NO: 546 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAEYAAQLAAAAAAA

SEQ ID NO: 547 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEXWAQLAAAAAAA

SEQ ID NO: 548 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Pmp
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEXWAQAASAA

SEQ ID NO: 549 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAHYWAQLAS

SEQ ID NO: 550 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 551 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 552 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 553 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLASAA

SEQ ID NO: 554 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 555 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 556 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 557 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 558 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAQYWAQAASAA

SEQ ID NO: 559 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAAAASAA

SEQ ID NO: 560 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 561 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAAA

SEQ ID NO: 562 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAAAA

SEQ ID NO: 563 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term OH
LTFAEYWAQLAAA

SEQ ID NO: 564 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAQLAAAAAAA

SEQ ID NO: 565 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAFWAALAAAAAAA

SEQ ID NO: 566 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4bOH2
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEFWAQAASAA

SEQ ID NO: 567 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAAAAAAA

SEQ ID NO: 568 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 569 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): pY
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASAA

SEQ ID NO: 570 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 571 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S5-pentynyl-alanine alkynyl amino acids, wherein the alkyne forms one half of a dialkyne bond with a second alkynyl amino acid
  C-term NH2
LTFAEYWAQAASAA

SEQ ID NO: 572 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAEYWAQLAAAAAAA

SEQ ID NO: 573 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 574 - protein, 17 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (11)..(11): Alpha-Me S6-hexynyl-alanine alkynyl amino acid crosslinked via an alkyne metathesis reaction with a second alkynyl amino acid
  MOD_RES (17)..(17): D-amino acid
  C-term NH2
LTFAEYWAQLAAAAAAA

SEQ ID NO: 575 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTFAEYWAQAASAA

SEQ ID NO: 576 - protein, 14 aa, Artificial Sequence
  Description of Artificial Sequence: Synthetic peptide
  N-term Ac
  MOD_RES (4)..(4): Alpha-Me R9-nonynyl-alanine alkynyl amino acid crosslinked via an alkyne metathesis reaction with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid crosslinked via an alkyne metathesis reaction with a second alkynyl amino acid
  C-term NH2
LTAAEYWAQAASAA

SEQ ID NO: 577 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R9-nonynyl-alanine alkynyl amino acid crosslinked via an alkyne metathesis reaction with a second alkynyl amino acid
  misc_feature (5)..(12): Crosslink between residues
  MOD_RES (11)..(11): Cyclobutyl-Ala
  MOD_RES (12)..(12): Alpha-Me S6-hexynyl-alanine alkynyl amino acid crosslinked via an alkyne metathesis reaction with a second alkynyl amino acid
  C-term NH2
ALTFAEYWAQAASAA

SEQ ID NO: 578 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 579 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 580 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 581 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAQLAAAAAAA

SEQ ID NO: 582 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
AATFAEYWAQLAAAAAAA

SEQ ID NO: 583 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALAFAEYWAQLAAAAAAA

SEQ ID NO: 584 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEAWAQLAAAAAAA

SEQ ID NO: 585 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYAAQLAAAAAAA

SEQ ID NO: 586 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYAAQLAAAAAAA

SEQ ID NO: 587 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAALAAAAAAA

SEQ ID NO: 588 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQAAAAAAAA

SEQ ID NO: 589 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 590 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 591 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 592 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 593 - protein, 17 aa, Artificial Sequence
  Description of Artificial Sequence: Synthetic peptide
  N-term 5-FAM
  MOD_RES (1)..(1): Beta-Ala
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AQSQQTFANLWRLLAQN

SEQ ID NO: 594 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 595 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYWAQAASAA

SEQ ID NO: 596 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYAAQAASAA

SEQ ID NO: 597 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTAAEYAAQAASAA

SEQ ID NO: 598 - protein, 15 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (11)..(11): Cyclobutyl-Ala
  MOD_RES (12)..(12): Alpha-Me S5-pentenyl-alanine olefin amino acid that is not connected by a crosslinker
  C-term NH2
ALTFAEYWAQAASAA

SEQ ID NO: 599 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 600 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTAAEYWAQLAAAAAAA

SEQ ID NO: 601 - protein, 18 aa, Artificial Sequence
  Description of Artificial Sequence: Synthetic peptide
  N-term 5-TAMRA
  MOD_RES (1)..(1): Beta-Ala
  MOD_RES (5)..(5): Alpha-Me R8-octenyl-alanine olefin amino acid that is not connected by a crosslinker
  MOD_RES (12)..(12): Alpha-Me S5-pentenyl-alanine olefin amino acid that is not connected by a crosslinker
  MOD_RES (18)..(18): D-amino acid
  C-term NH2
ALTFAEYWAQLAAAAAAA

SEQ ID NO: 602 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAASAA

SEQ ID NO: 603 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term OH
LTFAEYWXQAAS

SEQ ID NO: 604 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYWXQAASAA

SEQ ID NO: 605 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYAXQAASAA

SEQ ID NO: 606 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTAAEYAXQAASAA

SEQ ID NO: 607 - protein, 14 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (10)..(10): Cyclobutyl-Ala
  MOD_RES (11)..(11): Alpha-Me S5-pentenyl-alanine olefin amino acid that is not connected by a crosslinker
  C-term NH2
LTFAEYWXQAASAA

SEQ ID NO: 608 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWXQLAAAAAAA

SEQ ID NO: 609 - protein, 17 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (8)..(8): Cou7
  MOD_RES (11)..(11): Alpha-Me S5-pentenyl-alanine olefin amino acid that is not connected by a crosslinker
  MOD_RES (17)..(17): D-amino acid
  C-term NH2
LTFAEYWXQLAAAAAAA

SEQ ID NO: 610 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAAA

SEQ ID NO: 611 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAAA

SEQ ID NO: 612 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAAA

SEQ ID NO: 613 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAAA

SEQ ID NO: 614 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou7
  MOD_RES (11)..(11): Alpha-Me S5-pentenyl-alanine olefin amino acid connected by an all-carbon crosslinker comprising one double bond
  C-term OH
LTFAEYWXQLAA

SEQ ID NO: 615 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAASA

SEQ ID NO: 616 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 617 - protein, 18 aa, Artificial Sequence
  Description of Artificial Sequence: Synthetic peptide
  N-term Biotin
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 618 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 619 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAASA

SEQ ID NO: 620 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAASAA

SEQ ID NO: 621 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFASYWAQAASAA

SEQ ID NO: 622 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFARYWAQAASAA

SEQ ID NO: 623 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAKYWAQAASAA

SEQ ID NO: 624 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAEYWAQAAAAA

SEQ ID NO: 625 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  C-term NH2
LTFAEYWAQLAAAAAAAAC

SEQ ID NO: 626 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(18): D-amino acid
  MOD_RES (19)..(19): Peg4C
  C-term NH2
LTFAEYWAQLAAAAAAADC

SEQ ID NO: 627 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAALAAAAAAA

SEQ ID NO: 628 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 629 - protein, 18 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAAYWAALAAAAAAA

SEQ ID NO: 630 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTAAAYWAQLAAAAAAA

SEQ ID NO: 631 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 632 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAALAAAAAAA

SEQ ID NO: 633 - protein, 18 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (18)..(18): D-amino acid
  C-term NH2
ALTFAEYWAQLAAAAAAA

SEQ ID NO: 634 - protein, 15 aa, Artificial Sequence
  Description of Artificial Sequence: Synthetic peptide
  N-term FITC
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 635 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 636 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 637 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  MOD_RES (18)..(18): Beta-Ala
  MOD_RES (19)..(19): Lys-bio
  C-term NH2
LTFAEYWAQLAAAAAAAAK

SEQ ID NO: 638 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAALAAAAAAA

SEQ ID NO: 639 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAALAAAAAAA

SEQ ID NO: 640 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYAAQLAAAAAAA

SEQ ID NO: 641 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAEAAAAA

SEQ ID NO: 642 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAAYWAQLAEAAAAA

SEQ ID NO: 643 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAASAAAAA

SEQ ID NO: 644 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(15): Crosslink between residues
  MOD_RES (11)..(11): Two pentenyl-alanine olefin side chains, each of which is crosslinked to another amino acid as indicated
  MOD_RES (15)..(15): Alpha-Me R5-pentenyl-alanine olefin amino acid connected by an all-carbon crosslinker comprising one double bond
  C-term NH2
LTFAEYWAQLAAAAAAA

SEQ ID NO: 645 - protein, 18 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): Alpha-Me S5-pentenyl-alanine olefin amino acid connected by an all-carbon crosslinker comprising one double bond
  misc_feature (13)..(17): Crosslink between residues
  MOD_RES (17)..(17): Alpha-Me S5-pentenyl-alanine olefin amino acid connected by an all-carbon crosslinker comprising one double bond
  C-term NH2
LTFAEYWAQLAAAAAAAA

SEQ ID NO: 646 - protein, 19 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): Alpha-Me S5-pentenyl-alanine olefin amino acid connected by an all-carbon crosslinker comprising one double bond
  misc_feature (14)..(18): Crosslink between residues
  MOD_RES (18)..(18): Alpha-Me S5-pentenyl-alanine olefin amino acid connected by an all-carbon crosslinker comprising one double bond
  C-term NH2
LTFAEYWAQLAAAAAAAAA

SEQ ID NO: 647 - protein, 20 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): Alpha-Me S5-pentenyl-alanine olefin amino acid connected by an all-carbon crosslinker comprising one double bond
  misc_feature (15)..(19): Crosslink between residues
  MOD_RES (19)..(19): Alpha-Me S5-pentenyl-alanine olefin amino acid connected by an all-carbon crosslinker comprising one double bond
  C-term NH2
LTFAEYWAQLAAAAAAAAAA

SEQ ID NO: 648 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term OH
AAALTFAEYWAQLAAAA

SEQ ID NO: 649 - protein, 17 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAALTFAEYWAQLAAAA

SEQ ID NO: 650 - protein, 18 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
AAAALTFAEYWAQLAAAA

SEQ ID NO: 651 - protein, 19 aa, Artificial Sequence
  Description of Artificial Sequence: Synthetic peptide
  N-term Ac
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
  C-term NH2
AAAAALTFAEYWAQLAAAA

SEQ ID NO: 652 - protein, 20 aa, Artificial Sequence
  Description of Artificial Sequence: Synthetic peptide
  N-term Ac
  MOD_RES (10)..(10): Alpha-Me R8-octenyl-alanine olefin amino acid connected by an all-carbon crosslinker comprising one double bond
  misc_feature (10)..(17): Crosslink between residues
  MOD_RES (17)..(17): Alpha-Me S5-pentenyl-alanine olefin amino acid connected by an all-carbon crosslinker comprising one double bond
  C-term NH2
AAAAAALTFAEYWAQLAAAA

SEQ ID NO: 653 - protein, 14 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (10)..(10): Cyclobutyl-Ala
  MOD_RES (11)..(11): Alpha-Me S6-hexynyl-alanine alkynyl amino acid wherein the alkyne forms one half of a dialkyne bond with a second alkynyl amino acid
  C-term NH2
LTFAEYWAQAASAA

SEQ ID NO: 654 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me R5-pentenyl-alanine olefin amino acid connected by an all-carbon crosslinker comprising one double bond
  misc_feature (2)..(6): Crosslink between residues
  MOD_RES (3)..(5): D-amino acid
  MOD_RES (6)..(6): Alpha-Me R5-pentenyl-alanine olefin amino acid connected by an all-carbon crosslinker comprising one double bond
  MOD_RES (7)..(7): D-Phe-4CF3
  MOD_RES (8)..(12): D-amino acid
  C-term NH2
TAWYAAFEKLLR

SEQ ID NO: 655 - protein, 12 aa, Artificial Sequence
  Description of Artificial Sequence: Synthetic peptide
  N-term Ac
  MOD_RES (1)..(4): D-amino acid
  MOD_RES (5)..(5): Alpha-Me R5-pentenyl-alanine olefin amino acid connected by an all-carbon crosslinker comprising one double bond
  misc_feature (5)..(9): Crosslink between residues
  MOD_RES (6)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 656 - protein, 12 aa, Artificial Sequence
  Description of Artificial Sequence: Synthetic peptide
  N-term Ac
  MOD_RES (1)..(5): D-amino acid
  MOD_RES (6)..(6): Alpha-Me R5-pentenyl-alanine olefin amino acid connected by an all-carbon crosslinker comprising one double bond
  misc_feature (6)..(10): Crosslink between residues
  MOD_RES (7)..(7): D-Phe-4CF3
  MOD_RES (8)..(9): D-amino acid
  MOD_RES (10)..(10): Alpha-Me R5-pentenyl-alanine olefin amino acid connected by an all-carbon crosslinker comprising one double bond
  MOD_RES (11)..(12): D-amino acid
  C-term NH2
TAWYAAFEKALR

SEQ ID NO: 657 - protein, 14 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  misc_feature (9)..(13): Crosslink between residues
  MOD_RES (10)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYANFEALLRAA

SEQ ID NO: 658 - protein, 12 aa, Artificial Sequence
  Description of Artificial Sequence: Synthetic peptide
  N-term Ac
  MOD_RES (1)..(1): D-amino acid
  MOD_RES (2)..(2): Alpha-Me S8-octenyl-alanine olefin amino acid connected by an all-carbon crosslinker comprising one double bond
  misc_feature (2)..(9): Crosslink between residues
  MOD_RES (3)..(6): D-amino acid
  MOD_RES (7)..(7): D-Phe-4CF3
  MOD_RES (8)..(8): D-amino acid
  MOD_RES (9)..(9): Alpha-Me R5-pentenyl-alanine olefin amino acid connected by an all-carbon crosslinker comprising one double bond
  MOD_RES (10)..(12): D-amino acid
  C-term NH2
TAWYANFEALLR

SEQ ID NO: 659 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEKLLAA

SEQ ID NO: 660 - protein, 14 aa, Artificial Sequence
  Description of Artificial Sequence: Synthetic peptide
  N-term Ac
  MOD_RES (1)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-Phe-4CF3
  MOD_RES (8)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
TAWYAAFEKLLRAA

SEQ ID NO: 661 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANAEKLLAA

SEQ ID NO: 662 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(7): D-amino acid
  MOD_RES (8)..(8): D-Phe-4CF3
  MOD_RES (9)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANFEKLLAA

SEQ ID NO: 663 - protein, 14 aa, Artificial Sequence
  Description of Artificial Sequence: Synthetic peptide
  N-term 5-FAM
  MOD_RES (1)..(1): Beta-Ala
  MOD_RES (2)..(5): D-amino acid
  MOD_RES (6)..(6): Alpha-Me S8-octenyl-alanine olefin amino acid connected by an all-carbon crosslinker comprising one double bond
  misc_feature (6)..(13): Crosslink between residues
  MOD_RES (7)..(12): D-amino acid
  MOD_RES (13)..(13): Alpha-Me R5-pentenyl-alanine olefin amino acid connected by an all-carbon crosslinker comprising one double bond
  MOD_RES (14)..(14): D-amino acid
  C-term NH2
ATAWYANAEKLLAA

SEQ ID NO: 664 - protein, 13 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(13): D-amino acid
  C-term NH2
TAWYANFEALLAA

SEQ ID NO: 665 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEKLLAAAAAA

SEQ ID NO: 666 - protein, 17 aa, Artificial Sequence
  Description of Artificial Sequence: Synthetic peptide
  N-term Ac
  MOD_RES (1)..(4): D-amino acid
  MOD_RES (5)..(5): Alpha-Me S8-octenyl-alanine olefin amino acid connected by an all-carbon crosslinker comprising one double bond
  misc_feature (5)..(12): Crosslink between residues
  MOD_RES (6)..(6): D-amino acid
  MOD_RES (7)..(7): D-Phe-4CF3
  MOD_RES (8)..(11): D-amino acid
  MOD_RES (12)..(12): Alpha-Me R5-pentenyl-alanine olefin amino acid connected by an all-carbon crosslinker comprising one double bond
  MOD_RES (13)..(17): D-amino acid
  C-term NH2
TAWYANFEALLAAAAAA

SEQ ID NO: 667 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (14)..(14): Norleucine
  C-term NH2
LTFAEFWAQAASALA

SEQ ID NO: 668 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 669 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 670 - protein, 20 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  MOD_RES (20)..(20): D-amino acid
  C-term NH2
AAALTFAEYWAQLAAAAAAA

SEQ ID NO: 671 - protein, 17 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQLAAAAAAA

SEQ ID NO: 672 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): 2-aminoisobutyric acid
  MOD_RES (17)..(17): D-amino acid
  C-term NH2
LTFAEYWAQLAAXAAAA

SEQ ID NO: 673 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): 2-aminoisobutyric acid
  MOD_RES (17)..(17): D-amino acid
  C-term NH2
LTFAEYWAQLAAAAXAA

SEQ ID NO: 674 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): 2-aminoisobutyric acid
  MOD_RES (17)..(17): D-amino acid
  C-term NH2
LTFAEYWAQLAAAAAXA

SEQ ID NO: 675 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): 2-aminoisobutyric acid
  C-term NH2
LTFAEYWAQLAAAAAAX

SEQ ID NO: 676 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(17): D-amino acid
  C-term NH2
LTFAEYWAQLAAAAAAA

SEQ ID NO: 677 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAAAAAAA

SEQ ID NO: 678 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): Sarcosine
  C-term NH2
LTFAEYWAQLAAAAAAX

SEQ ID NO: 679 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term OH
LTFAEYWAQLAAAAAAA

SEQ ID NO: 680 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S5-pentynyl-alanine alkynyl amino acids, wherein the alkyne forms one half of a dialkyne bond with a second alkynyl amino acid
  MOD_RES (17)..(17): D-amino acid
  C-term NH2
LTFAAYWAQLAAAAAAA

SEQ ID NO: 681 - protein, 15 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (11)..(11): Cyclobutyl-Ala
  MOD_RES (12)..(12): Alpha-Me S5-pentenyl-alanine olefin amino acid connected by an all-carbon crosslinker comprising one double bond
  C-term NH2
ALTFAEYWAQAASAA

SEQ ID NO: 682 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 4-carboxy Phe
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEFWAQAAAAAAAA

SEQ ID NO: 683 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LTFAEYWAQAAAAAAAA

SEQ ID NO: 684 - protein, 16 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  MOD_RES (16)..(16): D-amino acid
  C-term NH2
TFAEYWAQLAAAAAAA

SEQ ID NO: 685 - protein, 15 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (15)..(15): D-amino acid
  C-term NH2
FAEYWAQLAAAAAAA

SEQ ID NO: 686 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
LVFAEYWAQLAAAAAAA

SEQ ID NO: 687 - protein, 17 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (17)..(17): D-amino acid
  C-term NH2
AAFAEYWAQLAAAAAAA

SEQ ID NO: 688 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (16)..(16): D-amino acid
  C-term NH2
LTFAEYWAQLAAAAAA

SEQ ID NO: 689 - protein, 15 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (15)..(15): D-amino acid
  C-term NH2
LTFAEYWAQLAAAAA

SEQ ID NO: 690 - protein, 14 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): D-amino acid
  C-term NH2
LTFAEYWAQLAAAA

SEQ ID NO: 691 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (13)..(13): D-amino acid
  C-term NH2
LTFAEYWAQLAAA

SEQ ID NO: 692 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAEYWAQLAA

SEQ ID NO: 693 - protein, 16 aa, Artificial Sequence
  Description of Artificial Sequence: Synthetic peptide
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (9)..(9): Alpha-Me S8-octenyl-alanine olefin amino acid connected by an all-carbon crosslinker comprising one double bond
LAQETFSDAWKLLPEN

SEQ ID NO: 694 - protein, 16 aa, Artificial Sequence
  Description of Artificial Sequence: Synthetic peptide
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
LSQATFSDLWALLPEN

SEQ ID NO: 695 - protein, 16 aa, Artificial Sequence
  Description of Artificial Sequence: Synthetic peptide
  MOD_RES (5)..(5): Alpha-Me R5-pentenyl-alanine olefin amino acid connected by an all-carbon crosslinker comprising one double bond
  misc_feature (5)..(12): Crosslink between residues
  MOD_RES (12)..(12): Alpha-Me S8-octenyl-alanine olefin amino acid connected by an all-carbon crosslinker comprising one double bond
LSQEAFSDLWKALPEN

SEQ ID NO: 696 - protein, 16 aa, Artificial Sequence
  Description of Artificial Sequence: Synthetic peptide
  MOD_RES (6)..(6): Alpha-Me R5-pentenyl-alanine olefin amino acid connected by an all-carbon crosslinker comprising one double bond
  misc_feature (6)..(13): Crosslink between residues
  MOD_RES (13)..(13): Alpha-Me S8-octenyl-alanine olefin amino acid connected by an all-carbon crosslinker comprising one double bond
LSQETASDLWKLAPEN

SEQ ID NO: 697 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAEN

SEQ ID NO: 698 - protein, 16 aa, Artificial Sequence
  Description of Artificial Sequence: Synthetic peptide
  MOD_RES (2)..(2): Any amino acid
  MOD_RES (8)..(8): Alpha-Me R5-pentenyl-alanine olefin amino acid connected by an all-carbon crosslinker comprising one double bond
  misc_feature (8)..(15): Crosslink between residues
  MOD_RES (15)..(15): Alpha-Me S8-octenyl-alanine olefin amino acid connected by an all-carbon crosslinker comprising one double bond
LXQETFSALWKLLPAN

SEQ ID NO: 699 - protein, 16 aa, Artificial Sequence
  Description of Artificial Sequence: Synthetic peptide
  MOD_RES (9)..(9): Alpha-Me R5-pentenyl-alanine olefin amino acid connected by an all-carbon crosslinker comprising one double bond
  misc_feature (9)..(16): Crosslink between residues
  MOD_RES (16)..(16): Alpha-Me S8-octenyl-alanine olefin amino acid connected by an all-carbon crosslinker comprising one double bond
LSQETFSDAWKLLPEA

SEQ ID NO: 700 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAEN

SEQ ID NO: 701 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFADLWKLLAQN

SEQ ID NO: 702 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFADLWKLLAQN

SEQ ID NO: 703 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQETFANLWKLLAQN

SEQ ID NO: 704 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWKLLAQN

SEQ ID NO: 705 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
LSQQTFANLWRLLAQN

SEQ ID NO: 706 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWKLLAQN

SEQ ID NO: 707 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 708 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 709 - protein, 16 aa, Artificial Sequence
  Description of Artificial Sequence: Synthetic peptide
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
LAQETFSDAWKLLPEN

SEQ ID NO: 710 - protein, 16 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
LSQATFSDLWALLPEN

SEQ ID NO: 711 - protein, 16 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
LSQEAFSDLWKALPEN

SEQ ID NO: 712 - protein, 16 aa, Artificial Sequence
  Description of Artificial Sequence: Synthetic peptide
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
LSQETASDLWKLAPEN

SEQ ID NO: 713 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAEN

SEQ ID NO: 714 - protein, 16 aa, Artificial Sequence
  Description of Artificial Sequence: Synthetic peptide
  MOD_RES (2)..(2): Any amino acid
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
LXQETFSALWKLLPAN

SEQ ID NO: 715 - protein, 16 aa, Artificial Sequence
  Description of Artificial Sequence: Synthetic peptide
  MOD_RES (9)..(9): Alpha-Me R8-octenyl-alanine olefin amino acid connected by an all-carbon crosslinker comprising one double bond
  misc_feature (9)..(16): Crosslink between residues
  MOD_RES (16)..(16): Alpha-Me S5-pentenyl-alanine olefin amino acid connected by an all-carbon crosslinker comprising one double bond
LSQETFSDAWKLLPEA

SEQ ID NO: 716 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAEN

SEQ ID NO: 717 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFADLWKLLAQN

SEQ ID NO: 718 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFADLWKLLAQN

SEQ ID NO: 719 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQETFANLWKLLAQN

SEQ ID NO: 720 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWKLLAQN

SEQ ID NO: 721 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
LSQQTFANLWRLLAQN

SEQ ID NO: 722 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWKLLAQN

SEQ ID NO: 723 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRLLAQN

SEQ ID NO: 724 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTAANLWRLLAQN

SEQ ID NO: 725 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFANLWRKKAQN

SEQ ID NO: 726 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLAEN

SEQ ID NO: 727 - protein, 12 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTFADLWRLLA

SEQ ID NO: 728 - protein, 13 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
LSQQTFADLWALL

SEQ ID NO: 729 - protein, 11 aa, Artificial Sequence
  Description of Artificial Sequence: Synthetic peptide
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
QQTFADLWALL

SEQ ID NO: 730 - protein, 14 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
QQTAADLWRLLAEN

SEQ ID NO: 731 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTFANLWRLLAQN

SEQ ID NO: 732 - protein, 16 aa, Artificial Sequence
  Description of Artificial Sequence: Synthetic peptide
  MOD_RES (7)..(7): Alpha-Me R5-pentenyl-alanine olefin amino acid connected by an all-carbon crosslinker comprising one double bond
  misc_feature (7)..(14): Crosslink between residues
  MOD_RES (14)..(14): Alpha-Me S8-octenyl-alanine olefin amino acid connected by an all-carbon crosslinker comprising one double bond
QSQQTAANLWRLLAQN

SEQ ID NO: 733 - protein, 16 aa, Artificial Sequence
  Description of Artificial Sequence: Synthetic peptide
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
QSQQTFADLWRLLAQN

SEQ ID NO: 734 - protein, 11 aa, Artificial Sequence
  Description of Artificial Sequence: Synthetic peptide
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
QTFANLWRLLA

SEQ ID NO: 735 - protein, 16 aa, Artificial Sequence
  Description of Artificial Sequence: Synthetic peptide
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
QSQQTFANLWALLPQN

SEQ ID NO: 736 - protein, 16 aa, Artificial Sequence
  Description of Artificial Sequence: Synthetic peptide
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
QSAQTFANLWRLLPQN

SEQ ID NO: 737 - protein, 10 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ATFSALWKLL

SEQ ID NO: 738 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
ETFADLWALL

SEQ ID NO: 739 - protein, 10 aa, Artificial Sequence
  Description of Artificial Sequence: Synthetic peptide
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
QTFANLWALL

SEQ ID NO: 740 - protein, 13 aa, Artificial Sequence
  Description of Artificial Sequence: Synthetic peptide
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
ASQEAFSNLWKLL

SEQ ID NO: 741 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFADLWKLLAEN

SEQ ID NO: 742 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQETFANLWKLLAQN

SEQ ID NO: 743 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
LSQQTFANLWRLLAQN

SEQ ID NO: 744 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWKLLAQN

SEQ ID NO: 745 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 746 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTAANLWRLLAQN

SEQ ID NO: 747 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWRLLAQN

SEQ ID NO: 748 - protein, 16 aa, Artificial Sequence
  Description of Artificial Sequence: Synthetic peptide
  N-term Ac
  C-term NH2
QSQQTFSNLWRLLPQN

SEQ ID NO: 749 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQN

SEQ ID NO: 750 - protein, 16 aa, Artificial Sequence
  Description of Artificial Sequence: Synthetic peptide
  N-term Ac
  MOD_RES (4)..(4): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQXTFANLWRLLAQN

SEQ ID NO: 751 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAAN

SEQ ID NO: 752 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLWRLLAQN

SEQ ID NO: 753 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFAALWRLLAQN

SEQ ID NO: 754 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQETFANLWRLLAQN

SEQ ID NO: 755 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAQN

SEQ ID NO: 756 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWRLLAEN

SEQ ID NO: 757 - protein, 16 aa, Artificial Sequence
  Description of Artificial Sequence: Synthetic peptide
  N-term Ac
  C-term NH2
LSQETFSDLWKLLPEN

SEQ ID NO: 758 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
QSQATFSALWRLLPQN

SEQ ID NO: 759 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
QSQQAFSNAWRLLPQN

SEQ ID NO: 760 - protein, 16 aa, Artificial Sequence
  Description of Artificial Sequence: Synthetic peptide
  N-term Ac
  MOD_RES (6)..(6): Alpha-Me S5-pentenyl-alanine olefin amino acid connected by an all-carbon crosslinker comprising one double bond
  misc_feature (6)..(10): Crosslink between residues
  MOD_RES (10)..(10): Alpha-Me S5-pentenyl-alanine olefin amino acid connected by an all-carbon crosslinker comprising one double bond
  C-term NH2
QSQQTASNLARLLPQN

SEQ ID NO: 761 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  C-term NH2
QSQQTFANLWALLPQN

SEQ ID NO: 762 - protein, 19 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (11)..(11): 2-aminoisobutyric acid
  MOD_RES (13)..(13): Norleucine
  MOD_RES (14)..(14): Alpha-Me S5-pentenyl-alanine olefin amino acid connected by an all-carbon crosslinker comprising one double bond
  MOD_RES (17)..(17): 2-aminoisobutyric acid
  C-term NH2
RTQATFANQWXALATNXTR

SEQ ID NO: 763 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLARN

SEQ ID NO: 764 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQRTFANLWRLLAQN

SEQ ID NO: 765 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 766 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 767 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 768 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTYANLWRLLAQN

SEQ ID NO: 769 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQTFANLWRLLAQN

SEQ ID NO: 770 - protein, 12 aa, Artificial Sequence
  Description of Artificial Sequence: Synthetic peptide
  N-term Ac
  C-term NH2
MPRFMDYWEGLN

SEQ ID NO: 771 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANLWRLLAQN

SEQ ID NO: 772 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQRFANLWRLLAQN

SEQ ID NO: 773 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RXQQRFANLWRLLAQN

SEQ ID NO: 774 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANFWRLLAQN

SEQ ID NO: 775 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQRFANYWRLLAQN

SEQ ID NO: 776 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTFANLWQLLAQN

SEQ ID NO: 777 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWQLLAQN

SEQ ID NO: 778 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): Alpha-Me-Leu
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 779 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWEGLAQN

SEQ ID NO: 780 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 781 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
RFANLWRLLAQ

SEQ ID NO: 782 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 2-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 783 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (9)..(9): 3-fluoro-Phe
  MOD_RES (14)..(14): Alpha-Me S5-pentenyl-alanine olefin amino acid connected by an all-carbon crosslinker comprising one double bond
  C-term NH2
QSQQTFANFWRLLAQN

SEQ ID NO: 784 - protein, 16 aa, Artificial Sequence
  Description of Artificial Sequence: Synthetic peptide
  N-term Ac
  MOD_RES (7)..(7): Alpha-hydrogen R8-octenyl-alanine olefin amino acid connected by an all-carbon saturated crosslinker with no double bond
  misc_feature (7)..(14): Crosslink between residues
  MOD_RES (14)..(14): Alpha-hydrogen S5-pentenyl-alanine olefin amino acid connected by an all-carbon saturated crosslinker with no double bond
  C-term NH2
QSQQTFANLWRLLAQN

SEQ ID NO: 785 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
RSQQTAANLWRLLAQN

SEQ ID NO: 786 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 787 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  C-term NH2
QSQATFSNLWRLLPQN

SEQ ID NO: 788 - protein, 16 aa, Artificial Sequence
  Description of Artificial Sequence: Synthetic peptide
  N-term acetylated with heptanoic acid and connected to internal olefin amino acid by an all-carbon crosslinker to position 4 comprising one double bond
  MOD_RES (4)..(4): Alpha-Me S5-pentenyl-alanine olefin amino acid connected by an all-carbon crosslinker to the N-term comprising one double bond
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQATFANLWRLLAQN

SEQ ID NO: 789 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 790 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Me6cl-Trp
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 791 - protein, 12 aa, Artificial Sequence
  Description of Artificial Sequence: Synthetic peptide
  N-term Ac
  C-term NH2
LTFEHYWAQLTS

SEQ ID NO: 792 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  C-term NH2
LTFAHYWAQLTS

SEQ ID NO: 793 - protein, 12 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  C-term NH2
LTFEAYWAALTS

SEQ ID NO: 794 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one Z configured double bond
  misc_feature (4)..(11): Crosslink between residues
  MOD_RES (11)..(11): Alpha-Me S5-pentenyl-alanine olefin amino acid connected by an all-carbon crosslinker comprising one Z configured double bond
  C-term NH2
LTFAHYWAQLAS

SEQ ID NO: 795 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWRQLAS

SEQ ID NO: 796 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(14): Crosslink between residues
  MOD_RES (14)..(14): Alpha-Me S8-octenyl-alanine olefin amino acid connected by an all-carbon crosslinker comprising one double bond
  C-term NH2
QSAQTFANLWRLLAQN

SEQ ID NO: 797 - protein, 16 aa, Artificial Sequence
  Description of Artificial Sequence: Synthetic peptide
  N-term Ac
  C-term NH2
QSQQTASNLWRLLPQN

SEQ ID NO: 798 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTAANLWRLLAQN

SEQ ID NO: 799 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
ASQQTFANLWRLLAQN

SEQ ID NO: 800 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid connected by an all-carbon crosslinker comprising one double bond
  misc_feature (1)..(5): Crosslink between residues
  MOD_RES (5)..(5): Alpha-Me S5-pentenyl-alanine olefin amino acid connected by an all-carbon crosslinker comprising one double bond
  MOD_RES (14)..(14): 2-aminoisobutyric acid
  C-term NH2
ASQQAFSNLWRLLXQN

SEQ ID NO: 801 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWRLLXQN

SEQ ID NO: 802 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid connected by an all-carbon crosslinker comprising one double bond
  misc_feature (5)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNAWRLLXQN

SEQ ID NO: 803 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid connected by an all-carbon crosslinker comprising one double bond
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFANLWALLXQN

SEQ ID NO: 804 - protein, 16 aa, Artificial Sequence
  Description of Artificial Sequence: Synthetic peptide
  N-term Ac
  MOD_RES (8)..(8): Alpha-Me S5-pentenyl-alanine olefin amino acid connected by an all-carbon crosslinker comprising one double bond
  misc_feature (8)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQTFSALWRALXQN

SEQ ID NO: 805 - protein, 16 aa, Artificial Sequence
  Description of Artificial Sequence: Synthetic peptide
  N-term Ac
  MOD_RES (11)..(11): Alpha-Me S5-pentenyl-alanine olefin amino acid connected by an all-carbon crosslinker comprising one double bond
  misc_feature (11)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSNLWALLAAN

SEQ ID NO: 806 - protein, 16 aa, Artificial Sequence
  Description of Artificial Sequence: Synthetic peptide
  N-term Ac
  MOD_RES (1)..(1): Alpha-Me S5-pentenyl-alanine olefin amino acid that is not connected by a crosslinker
  MOD_RES (5)..(5): Alpha-Me S5-pentenyl-alanine olefin amino acid that is not connected by a crosslinker
  MOD_RES (14)..(14): 2-aminoisobutyric acid
  C-term NH2
ASQQAFSNLWRLLXQN

SEQ ID NO: 807 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid that is not connected by a crosslinker
  MOD_RES (7)..(7): Alpha-Me S5-pentenyl-alanine olefin amino acid that is not connected by a crosslinker
  MOD_RES (14)..(14): 2-aminoisobutyric acid
  C-term NH2
QSAQTFANLWRLLXQN

SEQ ID NO: 808 - protein, 16 aa, Artificial Sequence
  Description of Artificial Sequence: Synthetic peptide
  N-term Ac
  MOD_RES (5)..(5): Alpha-Me S5-pentenyl-alanine olefin amino acid that is not connected by a crosslinker
  MOD_RES (9)..(9): Alpha-Me S5-pentenyl-alanine olefin amino acid that is not connected by a crosslinker
  MOD_RES (14)..(14): 2-aminoisobutyric acid
  C-term NH2
QSQQAFSNAWRLLXQN

SEQ ID NO: 809 - protein, 16 aa, Artificial Sequence
  Description of Artificial Sequence: Synthetic peptide
  N-term Ac
  MOD_RES (7)..(7): Alpha-Me S5-pentenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQQTFANLWALLXQN

SEQ ID NO: 810 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSALWRLLXQN

SEQ ID NO: 811 - protein, 16 aa, Artificial Sequence
  Description of Artificial Sequence: Synthetic peptide
  N-term Ac
  MOD_RES (4)..(4): Alpha-Me S5-pentenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
QSQATFSALWRLLXQN

SEQ ID NO: 812 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid not connected by any crosslinker
  MOD_RES (7)..(7): Amino acid comprising two pentenyl-alanine olefin side chains that are not crosslinked
  MOD_RES (14)..(14): Alpha-Me S8-octenyl-alanine olefin amino acid not connected by any crosslinker
  C-term NH2
QSAQTFANLWRLLAQN

SEQ ID NO: 813 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising one double bond
  misc_feature (1)..(8): Crosslink between residues
  MOD_RES (8)..(8): Alpha-Me S5-pentenyl-alanine olefin amino acid connected by an all-carbon crosslinker comprising one double bond
  MOD_RES (14)..(14): 2-aminoisobutyric acid
  C-term NH2
ASQQTFSALWRLLXQN

SEQ ID NO: 814 - protein, 16 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSQATFSNLWALLXQN

SEQ ID NO: 815 - protein, 16 aa, Artificial Sequence
  Description of Artificial Sequence: Synthetic peptide
  N-term Ac
  MOD_RES (8)..(8): Alpha-Me R8-octenyl-alanine olefin amino acid connected by an all-carbon crosslinker comprising one double bond
  misc_feature (8)..(15): Crosslink between residues
  MOD_RES (15)..(15): Alpha-Me S5-pentenyl-alanine olefin amino acid connected by an all-carbon crosslinker comprising one double bond
  C-term NH2
QSQQTFSALWRLLAAN

SEQ ID NO: 816 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me S5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 817 - protein, 16 aa, Artificial Sequence
  Description of Artificial Sequence: Synthetic peptide
  N-term Ac
  MOD_RES (1)..(1): Alpha-Me R8-octenyl-alanine olefin amino acid that is not connected by a crosslinker
  MOD_RES (8)..(8): Alpha-Me S5-pentenyl-alanine olefin amino acid that is not connected by a crosslinker
  MOD_RES (14)..(14): 2-aminoisobutyric acid
  C-term NH2
ASQQTFSALWRLLXQN

SEQ ID NO: 818 - protein, 16 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSQATFSNLWALLXQN

SEQ ID NO: 819 - protein, 16 aa, Artificial Sequence
  Description of Artificial Sequence: Synthetic peptide
  N-term Ac
  MOD_RES (8)..(8): Alpha-Me R8-octenyl-alanine olefin amino acid that is not connected by a crosslinker
  MOD_RES (15)..(15): Alpha-Me S5-pentenyl-alanine olefin amino acid that is not connected by a crosslinker
  C-term NH2
QSQQTFSALWRLLAAN

SEQ ID NO: 820 - protein, 16 aa, Artificial Sequence
  Description of Artificial Sequence: Synthetic peptide
  N-term Ac
  MOD_RES (3)..(3): Alpha-Me R5-pentenyl-alanine olefin amino acid that is not connected by a crosslinker
  MOD_RES (7)..(7): Amino acid comprising two pentenyl-alanine olefin side chains that are not crosslinked
  MOD_RES (11)..(11): Alpha-Me S5-pentenyl-alanine olefin amino acid that is not connected by a crosslinker
  MOD_RES (14)..(14): 2-aminoisobutyric acid
  C-term NH2
QSAQTFANLWALLXQN

SEQ ID NO: 821 - protein, 16 aa, Artificial Sequence
  Description of Artificial Sequence: Synthetic peptide
  N-term Ac
  MOD_RES (14)..(14): 2-aminoisobutyric acid
  C-term NH2
QSQQTFSNLWRLLXQN

SEQ ID NO: 822 - protein, 16 aa, Artificial Sequence
  Description of Artificial Sequence: Synthetic peptide
  N-term acetylated with heptanoic acid
  MOD_RES (4)..(4): Alpha-Me S5-pentenyl-alanine olefin amino acid that is not connected by a crosslinker
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQATFANLWRLLAQN

SEQ ID NO: 823 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ASQQTFANLRWLLAQN

SEQ ID NO: 824 - protein, 15 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Alpha-Me S5-pentenyl-alanine olefin amino acid that is not connected by a crosslinker
  C-term NH2
QSQQTFANLWRLLAQ

SEQ ID NO: 825 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 826 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAARAAAAAARAAAAA

SEQ ID NO: 827 - protein, 13 aa, Artificial Sequence
  Description of Artificial Sequence: Synthetic peptide
  N-term Ac
  C-term NH2
LTFEHYWAQLTSA

SEQ ID NO: 828 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLASA

SEQ ID NO: 829 - protein, 16 aa, Artificial Sequence
  Description of Artificial Sequence: Synthetic peptide
  N-term Ac
  C-term NH2
ASQQTFSNLWRLLPQN

SEQ ID NO: 830 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Two pentenyl-alanine olefin side chains, each of which is crosslinked to another amino acid as indicated
  misc_feature (7)..(11): Crosslink between residues
  MOD_RES (11)..(11): Alpha-Me R5-pentenyl-alanine olefin amino acid connected by an all-carbon crosslinker comprising one double bond
  MOD_RES (14)..(14): 2-aminoisobutyric acid
  C-term NH2
QSAQTFANLWALLXQN

SEQ ID NO: 831 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): 2-aminoisobutyric acid
  C-term NH2
QSQQTFXNLWRLLXQN

SEQ ID NO: 832 - protein, 16 aa, Artificial Sequence
  Description of Artificial Sequence: Synthetic peptide
  N-term Ac
  MOD_RES (7)..(7): Norleucine
  MOD_RES (14)..(14): Norleucine
  C-term NH2
QSQQTFLNLWRLLLQN

SEQ ID NO: 833 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): 2-aminoisobutyric acid
  C-term NH2
QSQQTFANLWRLLXQN

SEQ ID NO: 834 - protein, 16 aa, Artificial Sequence
  Description of Artificial Sequence: Synthetic peptide
  N-term Ac
  MOD_RES (7)..(7): Alpha-Me R8-octenyl-alanine olefin amino acid that is not connected by a crosslinker
  MOD_RES (14)..(14): Norleucine
  C-term NH2
QSQQTFANLWRLLLQN

SEQ ID NO: 835 - protein, 16 aa, Artificial Sequence
  Description of Artificial Sequence: Synthetic peptide
  N-term Ac
  MOD_RES (7)..(7): 2-aminoisobutyric acid
  MOD_RES (14)..(14): Alpha-Me S5-pentenyl-alanine olefin amino acid that is not connected by a crosslinker
  C-term NH2
QSQQTFXNLWRLLAQN

SEQ ID NO: 836 - protein, 16 aa, Artificial Sequence
  Description of Artificial Sequence: Synthetic peptide
  N-term Ac
  MOD_RES (7)..(7): Norleucine
  MOD_RES (14)..(14): Alpha-Me S5-pentenyl-alanine olefin amino acid that is not connected by a crosslinker
  C-term NH2
QSQQTFLNLWRLLAQN

SEQ ID NO: 837 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 838 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(3): Crosslink between residues
  MOD_RES (10)..(10): Me6clW
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 839 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 840 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 841 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQLLAA

SEQ ID NO: 842 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWELLAQN

SEQ ID NO: 843 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFADYWRLLAQN

SEQ ID NO: 844 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLAQ

SEQ ID NO: 845 - protein, 12 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANYWRLLA

SEQ ID NO: 846 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFADLWRLLAQN

SEQ ID NO: 847 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAEN

SEQ ID NO: 848 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAQD

SEQ ID NO: 849 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWRLLAS

SEQ ID NO: 850 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
ESQQTFANLWRLLAQN

SEQ ID NO: 851 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWRLLAQ

SEQ ID NO: 852 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LRFANLWRLLAQ

SEQ ID NO: 853 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANWWRLLAQN

SEQ ID NO: 854 - protein, 15 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQ

SEQ ID NO: 855 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
QTFANLWRLLAQN

SEQ ID NO: 856 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAQN

SEQ ID NO: 857 - protein, 13 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
LPRFANWWRLLAA

SEQ ID NO: 858 - protein, 10 aa, Artificial Sequence
  Description of Artificial Sequence: Synthetic peptide
  N-term Ac
  C-term NH2
TSFAEYWNLL

SEQ ID NO: 859 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
QTFAHWWSQLAS

SEQ ID NO: 860 - protein, 8 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (7)..(7): Alpha-Me S5-pentenyl-alanine olefin amino acid connected by an all-carbon crosslinker comprising one double bond
  C-term NH2
FMAYWEAL

SEQ ID NO: 861 - protein, 12 aa, Artificial Sequence
  Description of Artificial Sequence: Synthetic peptide
  N-term Ac
  C-term NH2
QTFEHWWSQLLS

SEQ ID NO: 862 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (10)..(10): Alpha-Me-Trp
  MOD_RES (13)..(13): Norleucine
  MOD_RES (14)..(14): Alpha-Me S5-pentenyl-alanine olefin amino acid connected by an all-carbon crosslinker comprising one double bond
  C-term NH2
QSQQTFANLWRLLAQN

SEQ ID NO: 863 - protein, 8 aa, Artificial Sequence
  Description of Artificial Sequence: Synthetic peptide
  N-term Ac
  MOD_RES (3)..(3): 2-aminoisobutyric acid
  MOD_RES (5)..(5): 6cl-Trp
  MOD_RES (7)..(7): Ac3c
  C-term NH2
FMXYWEXL

SEQ ID NO: 864 - protein, 8 aa, Artificial Sequence
  Description of Artificial Sequence: Synthetic peptide
  N-term Ac
  MOD_RES (2)..(2): Norleucine
  MOD_RES (3)..(3): Alpha-Me S5-pentenyl-alanine olefin amino acid connected by an all-carbon crosslinker comprising one double bond
  misc_feature (3)..(7): Crosslink between residues
  MOD_RES (5)..(5): 6cl-Trp
  MOD_RES (7)..(7): Alpha-Me S5-pentenyl-alanine olefin amino acid connected by an all-carbon crosslinker comprising one double bond
  C-term NH2
FLAYWEAL

SEQ ID NO: 865 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one Z configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one Z configured double bond
  C-term NH2
FAAYWEXLA

SEQ ID NO: 866 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 867 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising one double bond
  C-term NH2
LPRFANYWRLLAQN

SEQ ID NO: 868 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 869 - protein, 11 aa, Artificial Sequence
  Description of Artificial Sequence: Synthetic peptide
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 870 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 871 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (12)..(12): Norleucine
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 872 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLASA

SEQ ID NO: 873 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 874 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (8)..(8): 6cl-Trp
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 875 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 876 - protein, 16 aa, Artificial Sequence
  Description of Artificial Sequence: Synthetic peptide
  N-term Ac
  MOD_RES (3)..(3): Alpha-Me S5-pentenyl-alanine olefin amino acid connected by an all-carbon crosslinker comprising no double bonds
  misc_feature (3)..(7): Crosslink between residues
  MOD_RES (7)..(7): Amino acid comprising two pentenyl-alanine olefin side chains, each of which is crosslinked to another amino acid as indicated via fully saturated hydrocarbon crosslinks
  misc_feature (7)..(14): Crosslink between residues
  MOD_RES (14)..(14): Alpha-Me R8-octenyl-alanine olefin amino acid connected by an all carbon crosslinker comprising no double bonds
  C-term NH2
QSAQTFANLWRLLAQN

SEQ ID NO: 877 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising no double bonds
  C-term NH2
LTFAHYWRQLAS

SEQ ID NO: 878 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising no double bonds
  misc_feature (7)..(14): Crosslink between residues
  MOD_RES (10)..(10): 6cl-Trp
  MOD_RES (14)..(14): Alpha-Me S5-pentenyl-alanine olefin amino acid connected by an all-carbon crosslinker comprising no double bonds
  C-term NH2
QSQQTFANLWRLLAQN

SEQ ID NO: 879 - protein, 16 aa, Artificial Sequence
  Description of Artificial Sequence: Synthetic peptide
  N-term Ac
  MOD_RES (1)..(1): Alpha-Me R8-octenyl-alanine olefin amino acid connected by an all-carbon crosslinker comprising no double bonds
  misc_feature (1)..(8): Crosslink between residues
  MOD_RES (8)..(8): Alpha-Me S5-pentenyl-alanine olefin amino acid connected by an all-carbon crosslinker comprising no double bonds
  MOD_RES (14)..(14): 2-aminoisobutyric acid
  C-term NH2
ASQQTFSALWRLLXQN

SEQ ID NO: 880 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAS

SEQ ID NO: 881 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAQYWNLLAP

SEQ ID NO: 882 - protein, 12 aa, Artificial Sequence
  Description of Artificial Sequence: Synthetic peptide
  N-term Ac
  C-term NH2
LTFEHYWAQLTS

SEQ ID NO: 883 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one E configured double bond
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising one E configured double bond
  C-term NH2
FAAYWEXLA

SEQ ID NO: 884 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWALAAA

SEQ ID NO: 885 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 886 - protein, 11 aa, Artificial Sequence
  Description of Artificial Sequence: Synthetic peptide
  N-term Pr
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRLAAQ

SEQ ID NO: 887 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAS

SEQ ID NO: 888 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTFANLWRLLAQN

SEQ ID NO: 889 - protein, 23 aa, Artificial Sequence
  Description of Artificial Sequence: Synthetic peptide
  N-term Ac
  MOD_RES (7)..(7): Beta-Ala
  MOD_RES (14)..(14): Alpha-Me R8-octenyl-alanine olefin amino acid connected by an all-carbon crosslinker comprising one double bond
  misc_feature (14)..(21): Crosslink between residues
  MOD_RES (21)..(21): Alpha-Me S5-pentenyl-alanine olefin amino acid connected by an all-carbon crosslinker comprising one double bond
  C-term NH2
CCPGCCAQSQQTAANLWRLLAQN

SEQ ID NO: 890 - protein, 21 aa, Artificial Sequence
  Description of Artificial Sequence: Synthetic peptide
  N-term Ac
  MOD_RES (7)..(7): Beta-Ala
  MOD_RES (8)..(8): Norleucine
  MOD_RES (12)..(12): Alpha-Me R8-octenyl-alanine olefin amino acid connected by an all-carbon crosslinker comprising one double bond
  misc_feature (12)..(19): Crosslink between residues
  MOD_RES (19)..(19): Alpha-Me S5-pentenyl-alanine olefin amino acid connected by an all-carbon crosslinker comprising one double bond
  C-term NH2
CCPGCCALPRFANYWRLLAQN

SEQ ID NO: 891 - protein, 12 aa, Artificial Sequence
  Description of Artificial Sequence: Synthetic peptide
  N-term Ac
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTFAHYWAQLAS

SEQ ID NO: 892 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAHYWRXLA

SEQ ID NO: 893 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
QTFAHWWSQLAS

SEQ ID NO: 894 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWRQLAS

SEQ ID NO: 895 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 896 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 897 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 898 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 899 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 900 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAS

SEQ ID NO: 901 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAS

SEQ ID NO: 902 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEQLAS

SEQ ID NO: 903 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWEQLAS

SEQ ID NO: 904 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWAQLAS

SEQ ID NO: 905 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWAXLAS

SEQ ID NO: 906 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAHYWRXLAS

SEQ ID NO: 907 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-hydrogen S5-pentenyl-alanine olefin amino acid connected by an all-carbon crosslinker comprising one double bond
  C-term NH2
FAAYWEXLAA

SEQ ID NO: 908 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(3): Crosslink between residues
  MOD_RES (12)..(12): Alpha-Me S5-pentenyl-alanine olefin amino acid connected by an all-carbon crosslinker comprising no double bonds
  C-term NH2
LPTFANYWRLLAQN

SEQ ID NO: 909 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAQ

SEQ ID NO: 910 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 911 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising no double bonds
  misc_feature (2)..(9): Crosslink between residues
  MOD_RES (5)..(5): 6cl-Trp
  MOD_RES (7)..(7): Ac3c
  MOD_RES (9)..(9): Alpha-Me S5-pentenyl-alanine olefin amino acid connected by an all-carbon crosslinker comprising no double bonds
  C-term NH2
FAAYWEXLAA

SEQ ID NO: 912 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 913 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 914 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 915 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 916 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 917 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAS

SEQ ID NO: 918 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 919 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAS

SEQ ID NO: 920 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAAYWAQLAA

SEQ ID NO: 921 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAQLAA

SEQ ID NO: 922 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 923 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAA

SEQ ID NO: 924 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 925 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 926 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAALWALLAA

SEQ ID NO: 927 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
AAAYWEXLAA

SEQ ID NO: 928 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAA

SEQ ID NO: 929 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 930 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLAL

SEQ ID NO: 931 - protein, 10 aa, Artificial Sequence
  Description of Artificial Sequence: Synthetic peptide
  N-term Ac
  MOD_RES (2)..(2): Alpha-Me R5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S8-octenyl-alanine olefin amino acid connected by an all-carbon crosslinker comprising one double bond
  C-term NH2
FAAYWEXLAA

SEQ ID NO: 932 - protein, 10 aa, Artificial Sequence
  Description of Artificial Sequence: Synthetic peptide
  N-term Ac
  MOD_RES (2)..(2): Alpha-Me S5-pentenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me R8-octenyl-alanine olefin amino acid connected by an all-carbon crosslinker comprising one double bond
  C-term NH2
FAAYWEXLAA

SEQ ID NO: 933 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXIAA

SEQ ID NO: 934 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 935 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 936 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAA

SEQ ID NO: 937 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWQXLAA

SEQ ID NO: 938 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 939 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWXXLAA

SEQ ID NO: 940 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWLXLAA

SEQ ID NO: 941 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAXYWEXLAA

SEQ ID NO: 942 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FALYWEXLAA

SEQ ID NO: 943 - protein, 13 aa, Artificial Sequence
  Description of Artificial Sequence: Synthetic peptide
  N-term 5-FAM
  MOD_RES (1)..(1): Beta-Ala
  C-term NH2
ALTFEHYWAQLTS

SEQ ID NO: 944 - protein, 13 aa, Artificial Sequence
  Description of Artificial Sequence: Synthetic peptide
  N-term 5-FAM
  MOD_RES (1)..(1): Beta-Ala
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
ALTFAHYWAQLAS

SEQ ID NO: 945 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 946 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 947 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 948 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 949 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 950 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac6c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 951 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ac5c
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 952 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 953 - protein, 12 aa, Artificial Sequence
  Description of Artificial Sequence: Synthetic peptide
  N-term Ac
  MOD_RES (3)..(3): Indanyl-Gly
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTGAHYWAQLAS

SEQ ID NO: 954 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 955 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQFAS

SEQ ID NO: 956 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 957 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 958 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclopentyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 959 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): hY
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 960 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): hLeu
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 961 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Tert-butyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 962 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Adamantyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 963 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): homo-cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 964 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclohexyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 965 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac6c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 966 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac5c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 967 - protein, 10 aa, Artificial Sequence
  Description of Artificial Sequence: Synthetic peptide
  N-term Ac
  MOD_RES (1)..(1): homo-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 968 - protein, 10 aa, Artificial Sequence
  Description of Artificial Sequence: Synthetic peptide
  N-term Ac
  MOD_RES (1)..(1): Indanyl-Gly
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
GAAYWEXLAA

SEQ ID NO: 969 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXFAA

SEQ ID NO: 970 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Indanyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 971 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclobutyl-Ala
  MOD_RES (9)..(9): Alpha-Me S5-pentenyl-alanine olefin amino acid connected by an all-carbon crosslinker comprising one double bond
  C-term NH2
FAAYWEXAAA

SEQ ID NO: 972 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (8)..(8): Cyclopentyl-Gly
  MOD_RES (9)..(9): Alpha-Me S5-pentenyl-alanine olefin amino acid connected by an all-carbon crosslinker comprising one double bond
  C-term NH2
FAAYWEXGAA

SEQ ID NO: 973 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): hY
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 974 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAQ

SEQ ID NO: 975 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  C-term NH2
FAAYWEXLAA

SEQ ID NO: 976 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 977 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 978 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Ac3c
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 979 - protein, 12 aa, Artificial Sequence
  Description of Artificial Sequence: Synthetic peptide
  N-term Ac
  MOD_RES (1)..(1): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 980 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAHYWAQLAS

SEQ ID NO: 981 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAHYWAQLAS

SEQ ID NO: 982 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAHYWAQLAS

SEQ ID NO: 983 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
RTFAHYWAQLAS

SEQ ID NO: 984 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
KTFAHYWAQLAS

SEQ ID NO: 985 - protein, 12 aa, Artificial Sequence
  Description of Artificial Sequence: Synthetic peptide
  N-term Ac
  MOD_RES (2)..(2): Norleucine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LLFAHYWAQLAS

SEQ ID NO: 986 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAHYWAQLAS

SEQ ID NO: 987 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LFFAHYWAQLAS

SEQ ID NO: 988 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LWFAHYWAQLAS

SEQ ID NO: 989 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LRFAHYWAQLAS

SEQ ID NO: 990 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LKFAHYWAQLAS

SEQ ID NO: 991 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
LTFALYWAQLAS

SEQ ID NO: 992 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 993 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAS

SEQ ID NO: 994 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAWYWAQLAS

SEQ ID NO: 995 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFARYWAQLAS

SEQ ID NO: 996 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAKYWAQLAS

SEQ ID NO: 997 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Norleucine
  MOD_RES (11)..(11): Alpha-Me S5-pentenyl-alanine olefin amino acid connected by an all-carbon crosslinker comprising one double bond
  C-term NH2
LTFAHLWAQLAS

SEQ ID NO: 998 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHVWAQLAS

SEQ ID NO: 999 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1000 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1001 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1002 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1003 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAHYWLQLAS

SEQ ID NO: 1004 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWVQLAS

SEQ ID NO: 1005 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWFQLAS

SEQ ID NO: 1006 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1007 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWKQLAS

SEQ ID NO: 1008 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1009 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAVLAS

SEQ ID NO: 1010 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAFLAS

SEQ ID NO: 1011 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAWLAS

SEQ ID NO: 1012 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWARLAS

SEQ ID NO: 1013 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Norleucine
  C-term NH2
LTFAHYWAQLAL

SEQ ID NO: 1014 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAV

SEQ ID NO: 1015 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAF

SEQ ID NO: 1016 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1017 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAR

SEQ ID NO: 1018 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAK

SEQ ID NO: 1019 - protein, 16 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (14)..(14): 2-aminoisobutyric acid
  C-term NH2
QAQQTFSNAWRLLXQN

SEQ ID NO: 1020 - protein, 16 aa, Artificial Sequence
  Description of Artificial Sequence: Synthetic peptide
  N-term Ac
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  MOD_RES (14)..(14): 2-aminoisobutyric acid
  C-term NH2
QSQQAFSNLWRALXQN

SEQ ID NO: 1021 - protein, 12 aa, Artificial Sequence
  Description of Artificial Sequence: Synthetic peptide
  N-term Ac
  MOD_RES (3)..(3): 2Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1022 - protein, 12 aa, Artificial Sequence
  Description of Artificial Sequence: Synthetic peptide
  N-term Ac
  MOD_RES (3)..(3): 3Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1023 - protein, 12 aa, Artificial Sequence
  Description of Artificial Sequence: Synthetic peptide
  N-term Ac
  MOD_RES (3)..(3): 4Pal
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1024 - protein, 12 aa, Artificial Sequence
  Description of Artificial Sequence: Synthetic peptide
  N-term Ac
  MOD_RES (3)..(3): Phe-2CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1025 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1026 - protein, 12 aa, Artificial Sequence
  Description of Artificial Sequence: Synthetic peptide
  N-term Ac
  MOD_RES (3)..(3): Phe-2Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1027 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1028 - protein, 12 aa, Artificial Sequence
  Description of Artificial Sequence: Synthetic peptide
  N-term Ac
  MOD_RES (3)..(3): D-Phe-4CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1029 - protein, 12 aa, Artificial Sequence
  Description of Artificial Sequence: Synthetic peptide
  N-term Ac
  MOD_RES (3)..(3): Phe-4tBu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1030 - protein, 12 aa, Artificial Sequence
  Description of Artificial Sequence: Synthetic peptide
  N-term Ac
  MOD_RES (3)..(3): Phe-5F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1031 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(12): Crosslink between residues
  MOD_RES (7)..(7): 3Bth
  MOD_RES (12)..(12): Alpha-Me S5-pentenyl-alanine olefin amino acid connected by an all-carbon crosslinker comprising one double bond
  C-term NH2
LTFAHYXAAQLAS

SEQ ID NO: 1032 - protein, 12 aa, Artificial Sequence
  Description of Artificial Sequence: Synthetic peptide
  N-term Ac
  MOD_RES (3)..(3): Phe-2Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1033 - protein, 12 aa, Artificial Sequence
  Description of Artificial Sequence: Synthetic peptide
  N-term Ac
  MOD_RES (3)..(3): Phe-4Br
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1034 - protein, 12 aa, Artificial Sequence
  Description of Artificial Sequence: Synthetic peptide
  N-term Ac
  MOD_RES (3)..(3): Phe-2Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1035 - protein, 12 aa, Artificial Sequence
  Description of Artificial Sequence: Synthetic peptide
  N-term Ac
  MOD_RES (3)..(3): Phe-4Cl
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1036 - protein, 12 aa, Artificial Sequence
  Description of Artificial Sequence: Synthetic peptide
  N-term Ac
  MOD_RES (3)..(3): Phe-3CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1037 - protein, 12 aa, Artificial Sequence
  Description of Artificial Sequence: Synthetic peptide
  N-term Ac
  MOD_RES (3)..(3): Phe-4CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1038 - protein, 12 aa, Artificial Sequence
  Description of Artificial Sequence: Synthetic peptide
  N-term Ac
  MOD_RES (3)..(3): Phe-34Cl2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1039 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1040 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1041 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1042 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1043 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1044 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1045 - protein, 12 aa, Artificial Sequence
  Description of Artificial Sequence: Synthetic peptide
  N-term Ac
  MOD_RES (3)..(3): 4-iodo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1046 - protein, 12 aa, Artificial Sequence
  Description of Artificial Sequence: Synthetic peptide
  N-term Ac
  MOD_RES (3)..(3): Phe-3Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1047 - protein, 12 aa, Artificial Sequence
  Description of Artificial Sequence: Synthetic peptide
  N-term Ac
  MOD_RES (3)..(3): Phe-4Me
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1048 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1049 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1050 - protein, 12 aa, Artificial Sequence
  Description of Artificial Sequence: Synthetic peptide
  N-term Ac
  MOD_RES (3)..(3): Phe-3CF3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1051 - protein, 12 aa, Artificial Sequence
  Description of Artificial Sequence: Synthetic peptide
  N-term Ac
  MOD_RES (3)..(3): Phe-4NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1052 - protein, 12 aa, Artificial Sequence
  Description of Artificial Sequence: Synthetic peptide
  N-term Ac
  MOD_RES (3)..(3): Phe-3NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1053 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): 2Thi
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1054 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Bi-Phe
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1055 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4tBu
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1056 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): D-Phe-4CF3
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1057 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Cl
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1058 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Me
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1059 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4Br
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1060 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4CN
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1061 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Phe-4NO2
  MOD_RES (11)..(11): Alpha-Me S5-pentenyl-alanine olefin amino acid connected by an all-carbon crosslinker comprising one double bond
  C-term NH2
LTFAHFWAQLAS

SEQ ID NO: 1062 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 1-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1063 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): 2-Naphthalanine
  MOD_RES (11)..(11): Alpha-Me S5-pentenyl-alanine olefin amino acid connected by an all-carbon crosslinker comprising one double bond
  C-term NH2
LTFAHAWAQLAS

SEQ ID NO: 1064 - protein, 11 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(10): Crosslink between residues
  MOD_RES (10)..(10): Alpha-Me S5-pentenyl-alanine olefin amino acid connected by an all-carbon crosslinker comprising one double bond
  C-term NH2
LTFAHWAQLAS

SEQ ID NO: 1065 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 1-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1066 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 2-Naphthalanine
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1067 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQIAS

SEQ ID NO: 1068 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1069 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one E configured double bond
  misc_feature (4)..(11): Crosslink between residues
  MOD_RES (11)..(11): Alpha-Me S5-pentenyl-alanine olefin amino acid connected by an all-carbon crosslinker comprising one E configured double bond
  C-term NH2
LTFAHYWAQLAA

SEQ ID NO: 1070 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): Abu
  C-term NH2
LTFAHYWAQLAX

SEQ ID NO: 1071 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAHYWXQLAS

SEQ ID NO: 1072 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAHYWAQLAS

SEQ ID NO: 1073 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANLWALLAQ

SEQ ID NO: 1074 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAALWALLAQ

SEQ ID NO: 1075 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANLWALLAQ

SEQ ID NO: 1076 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAA

SEQ ID NO: 1077 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1078 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LVFAAYWAQLAS

SEQ ID NO: 1079 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Abu
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1080 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Norleucine
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1081 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Abu
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1082 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWHQLAS

SEQ ID NO: 1083 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWKQLAS

SEQ ID NO: 1084 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Ornithine
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1085 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAS

SEQ ID NO: 1086 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1087 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAS

SEQ ID NO: 1088 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRQLAA

SEQ ID NO: 1089 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWRALAA

SEQ ID NO: 1090 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAHYWAQLAS

SEQ ID NO: 1091 - protein, 12 aa, Artificial Sequence
  Description of Artificial Sequence: Synthetic peptide
  N-term Ac
  MOD_RES (4)..(4): Alpha-Me S5-pentenyl-alanine olefin amino acid connected by an all-carbon crosslinker comprising one double bond
  misc_feature (4)..(11): Crosslink between residues
  MOD_RES (11)..(11): Alpha-Me R8-octenyl-alanine olefin amino acid connected by an all-carbon crosslinker comprising one double bond
  C-term NH2
LTFAHYWAQLAS

SEQ ID NO: 1092 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAS

SEQ ID NO: 1093 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Abu
  MOD_RES (11)..(11): Alpha-Me S5-pentenyl-alanine olefin amino acid connected by an all-carbon crosslinker comprising one double bond
  C-term NH2
LTFAHYWAXLAS

SEQ ID NO: 1094 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWALLAS

SEQ ID NO: 1095 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHALAA

SEQ ID NO: 1096 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAA

SEQ ID NO: 1097 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1098 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWRALAA

SEQ ID NO: 1099 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALAA

SEQ ID NO: 1100 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1101 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAVYWEXLAA

SEQ ID NO: 1102 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAFYWEXLAA

SEQ ID NO: 1103 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAWYWEXLAA

SEQ ID NO: 1104 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FARYWEXLAA

SEQ ID NO: 1105 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAKYWEXLAA

SEQ ID NO: 1106 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Norleucine
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAALWEXLAA

SEQ ID NO: 1107 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAVWEXLAA

SEQ ID NO: 1108 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAA

SEQ ID NO: 1109 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAA

SEQ ID NO: 1110 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAARWEXLAA

SEQ ID NO: 1111 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAKWEXLAA

SEQ ID NO: 1112 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWVXLAA

SEQ ID NO: 1113 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWFXLAA

SEQ ID NO: 1114 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWWXLAA

SEQ ID NO: 1115 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWRXLAA

SEQ ID NO: 1116 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWKXLAA

SEQ ID NO: 1117 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEVLAA

SEQ ID NO: 1118 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEFLAA

SEQ ID NO: 1119 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEWLAA

SEQ ID NO: 1120 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWERLAA

SEQ ID NO: 1121 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEKLAA

SEQ ID NO: 1122 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAV

SEQ ID NO: 1123 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAF

SEQ ID NO: 1124 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAW

SEQ ID NO: 1125 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAR

SEQ ID NO: 1126 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAK

SEQ ID NO: 1127 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAV

SEQ ID NO: 1128 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAF

SEQ ID NO: 1129 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAW

SEQ ID NO: 1130 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAR

SEQ ID NO: 1131 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAK

SEQ ID NO: 1132 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAH

SEQ ID NO: 1133 - protein, 12 aa, Artificial Sequence
  Description of Artificial Sequence: Synthetic peptide
  N-term Ac
  MOD_RES (3)..(3): Phe-2NO2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1134 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1135 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYAAQLAS

SEQ ID NO: 1136 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QSQQTFANLWALLAAN

SEQ ID NO: 1137 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFANLWALLAAN

SEQ ID NO: 1138 - protein, 16 aa, Artificial Sequence
  Description of Artificial Sequence: Synthetic peptide
  N-term Ac
  MOD_RES (2)..(2): 2-aminoisobutyric acid
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
QXQQTFAALWALLAAN

SEQ ID NO: 1139 - protein, 16 aa, Artificial Sequence
  Description of Artificial Sequence: Synthetic peptide
  N-term Ac
  MOD_RES (7)..(7): Alpha-Me R8-octenyl-alanine olefin amino acid connected by an all-carbon crosslinker comprising one double bond
  misc_feature (7)..(14): Crosslink between residues
  MOD_RES (14)..(14): Alpha-Me S5-pentenyl-alanine olefin amino acid connected by an all-carbon crosslinker comprising one double bond
  C-term NH2
AAAATFAAAWAALAAA

SEQ ID NO: 1140 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAAWRALAQ

SEQ ID NO: 1141 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWAALAQ

SEQ ID NO: 1142 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWRALAA

SEQ ID NO: 1143 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
VFAAAWRALAQ

SEQ ID NO: 1144 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
AFAAAWAALAA

SEQ ID NO: 1145 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWKALAQ

SEQ ID NO: 1146 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (7)..(7): Ornithine
  MOD_RES (10)..(10): Alpha-Me S5-pentenyl-alanine olefin amino acid connected by an all-carbon crosslinker comprising one double bond
  C-term NH2
TFAAAWXALAQ

SEQ ID NO: 1147 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAAWSALAQ

SEQ ID NO: 1148 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAAWRALAQ

SEQ ID NO: 1149 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAA

SEQ ID NO: 1150 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAALAA

SEQ ID NO: 1151 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWAQLAA

SEQ ID NO: 1152 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1153 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALA

SEQ ID NO: 1154 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKALA

SEQ ID NO: 1155 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXALA

SEQ ID NO: 1156 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALA

SEQ ID NO: 1157 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLA

SEQ ID NO: 1158 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWDQLAS

SEQ ID NO: 1159 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHFWEQLAS

SEQ ID NO: 1160 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWHQLAS

SEQ ID NO: 1161 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWKQLAS

SEQ ID NO: 1162 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAYWXQLAS

SEQ ID NO: 1163 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHYWSQLAS

SEQ ID NO: 1164 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWEQLAS

SEQ ID NO: 1165 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWAQLAS

SEQ ID NO: 1166 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWHQLAS

SEQ ID NO: 1167 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAWWKQLAS

SEQ ID NO: 1168 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Ornithine
  MOD_RES (9)..(9): Alpha-Me S5-pentenyl-alanine olefin amino acid connected by an all-carbon crosslinker comprising one double bond
  C-term NH2
FAAWWXQLAS

SEQ ID NO: 1169 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAHWWSQLAS

SEQ ID NO: 1170 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAQ

SEQ ID NO: 1171 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAQ

SEQ ID NO: 1172 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFANYWALLAA

SEQ ID NO: 1173 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFANLWAQLAA

SEQ ID NO: 1174 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LTFAAYWALLAQ

SEQ ID NO: 1175 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1176 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFANYWALLAQ

SEQ ID NO: 1177 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFANLWAQLAQ

SEQ ID NO: 1178 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (9)..(9): Norleucine
  MOD_RES (11)..(11): Alpha-Me S5-pentenyl-alanine olefin amino acid connected by an all-carbon crosslinker comprising one double bond
  C-term NH2
LAFAAYWALLAA

SEQ ID NO: 1179 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAALWAQLAA

SEQ ID NO: 1180 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LAFAAYWAALAA

SEQ ID NO: 1181 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (11)..(11): 2-aminoisobutyric acid
  C-term NH2
FAAYWEXLAAX

SEQ ID NO: 1182 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1183 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWAXLAAA

SEQ ID NO: 1184 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWSXLAAA

SEQ ID NO: 1185 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAS

SEQ ID NO: 1186 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAT

SEQ ID NO: 1187 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAL

SEQ ID NO: 1188 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLAAQ

SEQ ID NO: 1189 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAFWEXLAAA

SEQ ID NO: 1190 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAWWEXLAAA

SEQ ID NO: 1191 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  C-term NH2
FAAYWEXLASA

SEQ ID NO: 1192 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1193 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1194 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1195 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1196 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1197 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEALALA

SEQ ID NO: 1198 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWELLALA

SEQ ID NO: 1199 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1200 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1201 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1202 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAFWAQLAS

SEQ ID NO: 1203 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1204 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAS

SEQ ID NO: 1205 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1206 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLASA

SEQ ID NO: 1207 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAA

SEQ ID NO: 1208 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQIAA

SEQ ID NO: 1209 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Norleucine
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1210 - protein, 13 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAAA

SEQ ID NO: 1211 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHWWAQLAS

SEQ ID NO: 1212 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHRWAQLAS

SEQ ID NO: 1213 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHKWAQLAS

SEQ ID NO: 1214 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAW

SEQ ID NO: 1215 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAA

SEQ ID NO: 1216 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAA

SEQ ID NO: 1217 - protein, 14 aa, Artificial Sequence
  Description of Artificial Sequence: Synthetic peptide
  N-term Ac
  MOD_RES (1)..(1): Norleucine
  MOD_RES (5)..(5): Alpha-Me R8-octenyl-alanine olefin amino acid connected by an all-carbon crosslinker comprising no double bonds
  misc_feature (5)..(12): Crosslink between residues
  MOD_RES (12)..(12): Alpha-Me S5-pentenyl-alanine olefin amino acid connected by an all-carbon crosslinker comprising no double bonds
  C-term NH2
LPRFANYWRLLAQN

SEQ ID NO: 1218 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
TSFAHYWAQLAS

SEQ ID NO: 1219 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAAYWAQLAS

SEQ ID NO: 1220 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HTFAHYWAQLAS

SEQ ID NO: 1221 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAHYWAQLAS

SEQ ID NO: 1222 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHHWAQLAS

SEQ ID NO: 1223 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWHQLAS

SEQ ID NO: 1224 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAHLAS

SEQ ID NO: 1225 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAH

SEQ ID NO: 1226 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPr
LTFAHYWAQLAS

SEQ ID NO: 1227 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1228 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiBu
LTFAHYWAQLAS

SEQ ID NO: 1229 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHBn
LTFAHYWAQLAS

SEQ ID NO: 1230 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHPe
LTFAHYWAQLAS

SEQ ID NO: 1231 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHChx
LTFAHYWAQLAS

SEQ ID NO: 1232 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1233 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1234 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LEFAAYWAQLAS

SEQ ID NO: 1235 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LSFAAYWAQLAS

SEQ ID NO: 1236 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1237 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFASYWAQLAS

SEQ ID NO: 1238 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWEQLAS

SEQ ID NO: 1239 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1240 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWASLAS

SEQ ID NO: 1241 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1242 - protein, 12 aa, Artificial Sequence
  Description of Artificial Sequence: Synthetic peptide
  N-term Ac
  MOD_RES (3)..(3): Phe-2CN
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1243 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1244 - protein, 12 aa, Artificial Sequence
  Description of Artificial Sequence: Synthetic peptide
  N-term Ac
  MOD_RES (3)..(3): 3,3-di-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTXAHYWAQLAS

SEQ ID NO: 1245 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Tert-butyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1246 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1247 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6br-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1248 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl6f-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1249 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1250 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1251 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl7m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1252 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising no double bonds
  misc_feature (4)..(11): Crosslink between residues
  MOD_RES (11)..(11): Alpha-Me S5-pentenyl-alanine olefin amino acid connected by an all-carbon crosslinker comprising no double bonds
  C-term NH2
LTFAHYWAQLAA

SEQ ID NO: 1253 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1254 - protein, 12 aa, Artificial Sequence
  Description of Artificial Sequence: Synthetic peptide
  N-term Ac
  MOD_RES (6)..(6): Cou
  C-term NH2
LTFEHXWAQLTS

SEQ ID NO: 1255 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTAAHXWAQLAS

SEQ ID NO: 1256 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAXA

SEQ ID NO: 1257 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEAIAAA

SEQ ID NO: 1258 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (8)..(8): Norleucine
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1259 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Alpha-Me-Leu
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1260 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1261 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAALAAA

SEQ ID NO: 1262 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Abu
  MOD_RES (9)..(9): Alpha-Me S5-pentenyl-alanine olefin amino acid connected by an all-carbon crosslinker comprising one double bond
  C-term NH2
FAAYWXALAAA

SEQ ID NO: 1263 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (6)..(6): Norleucine
  MOD_RES (9)..(9): Alpha-Me S5-pentenyl-alanine olefin amino acid connected by an all-carbon crosslinker comprising one double bond
  C-term NH2
FAAYWLALAAA

SEQ ID NO: 1264 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Abu
  MOD_RES (9)..(9): Alpha-Me S5-pentenyl-alanine olefin amino acid connected by an all-carbon crosslinker comprising one double bond
  C-term NH2
FAXYWEALAAA

SEQ ID NO: 1265 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (3)..(3): Norleucine
  MOD_RES (9)..(9): Alpha-Me S5-pentenyl-alanine olefin amino acid connected by an all-carbon crosslinker comprising one double bond
  C-term NH2
FALYWEALAAA

SEQ ID NO: 1266 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAFYWEALAAA

SEQ ID NO: 1267 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1268 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Adamantyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1269 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Indanyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1270 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWAQLAAA

SEQ ID NO: 1271 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAALWAQLAQ

SEQ ID NO: 1272 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1273 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  C-term NH2
FAAYWELLAAA

SEQ ID NO: 1274 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): 2-aminoisobutyric acid
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAX

SEQ ID NO: 1275 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Norleucine
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWELLAX

SEQ ID NO: 1276 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEALAX

SEQ ID NO: 1277 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Abu
  C-term NH2
FAAYWEXLAXA

SEQ ID NO: 1278 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (7)..(7): Ac3c
  MOD_RES (9)..(9): Alpha-Me S5-pentenyl-alanine olefin amino acid connected by an all-carbon crosslinker comprising one double bond
  MOD_RES (10)..(10): Norleucine
  C-term NH2
FAAYWEXLALA

SEQ ID NO: 1279 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1280 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1281 - protein, 12 aa, Artificial Sequence
  Description of Artificial Sequence: Synthetic peptide
  N-term mdPEG7
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1282 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): Pmp
  MOD_RES (5)..(5): Et6cl-Trp
  MOD_RES (9)..(9): Alpha-Me S5-pentenyl-alanine olefin amino acid connected by an all-carbon crosslinker comprising one double bond
  C-term NH2
FAAXWEALAA

SEQ ID NO: 1283 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1284 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAQLAA

SEQ ID NO: 1285 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAS

SEQ ID NO: 1286 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1287 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAS

SEQ ID NO: 1288 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWWQLAA

SEQ ID NO: 1289 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWWQLAA

SEQ ID NO: 1290 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1291 - protein, 12 aa, Artificial Sequence
  Description of Artificial Sequence: Synthetic peptide
  N-term Ac
  MOD_RES (3)..(3): 2-Fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1292 - protein, 12 aa, Artificial Sequence
  Description of Artificial Sequence: Synthetic peptide
  N-term Ac
  MOD_RES (3)..(3): 3-fluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1293 - protein, 12 aa, Artificial Sequence
  Description of Artificial Sequence: Synthetic peptide
  N-term Ac
  MOD_RES (3)..(3): 3,4-difluoro Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1294 - protein, 12 aa, Artificial Sequence
  Description of Artificial Sequence: Synthetic peptide
  N-term Ac
  MOD_RES (3)..(3): 3,5-difluoro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1295 - protein, 10 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1296 - protein, 11 aa, Artificial Sequence
  Description of Artificial Sequence: Synthetic peptide
  N-term Ac
  MOD_RES (1)..(1): 3-Chloro-Phe
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1297 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALAAA

SEQ ID NO: 1298 - protein, 9 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWEALA

SEQ ID NO: 1299 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  MOD_RES (11)..(11): Amino acid comprising two pentenyl-alanine olefin side chains that are not crosslinked
  C-term NH2
LTFAHYWAQLAS

SEQ ID NO: 1300 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHsBu
LTFAHYWAQLAS

SEQ ID NO: 1301 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
STFAAYWAQLAS

SEQ ID NO: 1302 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAELAS

SEQ ID NO: 1303 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAE

SEQ ID NO: 1304 - protein, 12 aa, Artificial Sequence
  Description of Artificial Sequence: Synthetic peptide
  N-term mdPEG3
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1305 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1306 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1307 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1308 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1309 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1310 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1311 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1312 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAHYWAQGAS

SEQ ID NO: 1313 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1314 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1315 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1316 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1317 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1318 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1319 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1320 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1321 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1322 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1323 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1324 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3Me
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1325 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1326 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1327 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAFYWAQLAA

SEQ ID NO: 1328 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1329 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1330 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1331 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1332 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1333 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1334 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1335 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1336 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1337 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg4
LTFAAYWAQLAA

SEQ ID NO: 1338 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl4m-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1339 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): dl5cl-Trp
  MOD_RES (9)..(9): Alpha-Me S5-pentenyl-alanine olefin amino acid connected by an all-carbon crosslinker comprising one double bond
  C-term NH2
FAAYWEALAA

SEQ ID NO: 1340 - protein, 12 aa, Artificial Sequence
  Description of Artificial Sequence: Synthetic peptide
  N-term Ac
  MOD_RES (3)..(3): homo-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1341 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1342 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1343 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1344 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAHYWAALAA

SEQ ID NO: 1345 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAA

SEQ ID NO: 1346 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAIYWAQLAS

SEQ ID NO: 1347 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1348 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1349 - protein, 12 aa, Artificial Sequence
  Description of Artificial Sequence: Synthetic peptide
  N-term Ac
  MOD_RES (1)..(1): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAVYWSQLAS

SEQ ID NO: 1350 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1351 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1352 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWAQLAS

SEQ ID NO: 1353 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAWYWAQLAS

SEQ ID NO: 1354 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1355 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAFYWSQLAS

SEQ ID NO: 1356 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAIYWAQLAS

SEQ ID NO: 1357 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1358 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFALYWSQLAS

SEQ ID NO: 1359 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1360 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWEALAA

SEQ ID NO: 1361 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1362 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1363 - protein, 11 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWQALAAA

SEQ ID NO: 1364 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LHFAAYWAQLAS

SEQ ID NO: 1365 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1366 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1367 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1368 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1369 - protein, 13 aa, Artificial Sequence
  Description of Artificial Sequence: Synthetic peptide
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
HLTFAAYWAQLAA

SEQ ID NO: 1370 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1371 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1372 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1373 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1374 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1375 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1376 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1377 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1378 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1379 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1380 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1381 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1382 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1383 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1384 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1385 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1386 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1387 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1388 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LGFAAYWAQLAS

SEQ ID NO: 1389 - protein, 12 aa, Artificial Sequence
  Description of Artificial Sequence: Synthetic peptide
  N-term Ac
  MOD_RES (3)..(3): N-methyl-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1390 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1391 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1392 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1393 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1394 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAALAS

SEQ ID NO: 1395 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): homo-cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1396 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1397 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1398 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Phe-3CF3
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1399 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): 1-Naphthalanine
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1400 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Bi-Phe
  MOD_RES (11)..(11): Alpha-Me S5-pentenyl-alanine olefin amino acid connected by an all-carbon crosslinker comprising one double bond
  C-term NH2
LTFAAYWAQFAS

SEQ ID NO: 1401 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWAQLAS

SEQ ID NO: 1402 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWVQLAS

SEQ ID NO: 1403 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAWWAQLAS

SEQ ID NO: 1404 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAVYWSQLAS

SEQ ID NO: 1405 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAFYWAQLAS

SEQ ID NO: 1406 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFALYWSQLAS

SEQ ID NO: 1407 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAFYWAQLAS

SEQ ID NO: 1408 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
VTFAAYWSQLAS

SEQ ID NO: 1409 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAHWAQLAS

SEQ ID NO: 1410 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAH

SEQ ID NO: 1411 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAHLAS

SEQ ID NO: 1412 - protein, 14 aa, Artificial Sequence
  Description of Artificial Sequence: Synthetic peptide
  N-term Ac
  MOD_RES (1)..(1): D-amino acid
  MOD_RES (2)..(2): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
AXWTFAVYWSQLAS

SEQ ID NO: 1413 - protein, 13 aa, Artificial Sequence
  Description of Artificial Sequence: Synthetic peptide
  N-term Ac
  MOD_RES (1)..(1): 2-aminoisobutyric acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
XWTFAHYWAQLAS

SEQ ID NO: 1414 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XAWTFAHYWAQLAS

SEQ ID NO: 1415 - protein, 13 aa, Artificial Sequence
  Description of Artificial Sequence: Synthetic peptide
  N-term Ac
  MOD_RES (1)..(1): D-amino acid
  MOD_RES (5)..(5): Alpha-Me R8-octenyl-alanine olefin amino acid connected by an all-carbon crosslinker comprising one double bond
  misc_feature (5)..(12): Crosslink between residues
  MOD_RES (12)..(12): Alpha-Me S5-pentenyl-alanine olefin amino acid connected by an all-carbon crosslinker comprising one double bond
  C-term NH2
FWTFAHYWAQLAS

SEQ ID NO: 1416 - protein, 14 aa, Artificial Sequence
  Description of Artificial Sequence: Synthetic peptide
  N-term Ac
  MOD_RES (1)..(1): 2-aminoisobutyric acid
  MOD_RES (6)..(6): Alpha-Me R8-octenyl-alanine olefin amino acid connected by an all-carbon crosslinker comprising one double bond
  misc_feature (6)..(13): Crosslink between residues
  MOD_RES (13)..(13): Alpha-Me S5-pentenyl-alanine olefin amino acid connected by an all-carbon crosslinker comprising one double bond
  C-term NH2
XWWTFAHYWAQLAS

SEQ ID NO: 1417 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1418 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Norleucine
  MOD_RES (11)..(11): Alpha-Me S5-pentenyl-alanine olefin amino acid connected by an all-carbon crosslinker comprising one double bond
  C-term NH2
WTFALYWSQLAS

SEQ ID NO: 1419 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  MOD_RES (12)..(12): D-amino acid
  C-term NH2
LTFAAYWSQLAA

SEQ ID NO: 1420 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWARLAA

SEQ ID NO: 1421 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAHLAA

SEQ ID NO: 1422 - protein, 12 aa, Artificial Sequence
  Description of Artificial Sequence: Synthetic peptide
  N-term Ac
  MOD_RES (1)..(1): D-amino acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ATFAAYWAQLAS

SEQ ID NO: 1423 - protein, 12 aa, Artificial Sequence
  Description of Artificial Sequence: Synthetic peptide
  N-term Ac
  MOD_RES (1)..(1): 2-aminoisobutyric acid
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1424 - protein, 12 aa, Artificial Sequence
  Description of Artificial Sequence: Synthetic peptide
  N-term Ac
  MOD_RES (1)..(1): Alpha-Me-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
FTFAAYWAQLAS

SEQ ID NO: 1425 - protein, 12 aa, Artificial Sequence
  Description of Artificial Sequence: Synthetic peptide
  N-term Ac
  MOD_RES (1)..(1): Alpha-Me-Trp
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAAYWAQLAS

SEQ ID NO: 1426 - protein, 12 aa, Artificial Sequence
  Description of Artificial Sequence: Synthetic peptide
  N-term Ac
  MOD_RES (1)..(1): N-methyl-Leu
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1427 - protein, 12 aa, Artificial Sequence
  Description of Artificial Sequence: Synthetic peptide
  N-term Ac
  MOD_RES (2)..(2): N-methyl-Thr
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1428 - protein, 12 aa, Artificial Sequence
  Description of Artificial Sequence: Synthetic peptide
  N-term Ac
  MOD_RES (2)..(2): Sarcosine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LXFAAYWAQLAS

SEQ ID NO: 1429 - protein, 11 aa, Artificial Sequence
  Description of Artificial Sequence: Synthetic peptide
  N-term Ac
  MOD_RES (3)..(3): Alpha-Me R8-octenyl-alanine olefin amino acid connected by an all-carbon crosslinker comprising one double bond
  misc_feature (3)..(10): Crosslink between residues
  MOD_RES (10)..(10): Alpha-Me S5-pentenyl-alanine olefin amino acid connected by an all-carbon crosslinker comprising one double bond
  C-term NH2
TFAAYWAQLAS

SEQ ID NO: 1430 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAA

SEQ ID NO: 1431 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAA

SEQ ID NO: 1432 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
WTFAVYWSQLAS

SEQ ID NO: 1433 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
YTFAFYWSQLAS

SEQ ID NO: 1434 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (5)..(5): 6cl-Trp
  MOD_RES (9)..(9): Alpha-Me S5-pentenyl-alanine olefin amino acid connected by an all-carbon crosslinker comprising one double bond
  C-term NH2
FAAYWSALAA

SEQ ID NO: 1435 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVQLAS

SEQ ID NO: 1436 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAQLAA

SEQ ID NO: 1437 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAQLAS

SEQ ID NO: 1438 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVQLAA

SEQ ID NO: 1439 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAQLAS

SEQ ID NO: 1440 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1441 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1442 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1443 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1444 - protein, 12 aa, Artificial Sequence
  Description of Artificial Sequence: Synthetic peptide
  N-term Ac
  MOD_RES (3)..(3): 3-Chloro-Phe
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAAYWAQAAS

SEQ ID NO: 1445 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (7)..(7): 6cl-Trp
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1446 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAHYWAQLAS

SEQ ID NO: 1447 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclobutyl-Ala
  MOD_RES (11)..(11): Alpha-Me S5-pentenyl-alanine olefin amino acid connected by an all-carbon crosslinker comprising one double bond
  C-term NH2
LTFAHYWAQAAS

SEQ ID NO: 1448 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): hLeu
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1449 - protein, 12 aa, Artificial Sequence
  Description of Artificial Sequence: Synthetic peptide
  N-term Ac
  MOD_RES (3)..(3): Phe-4F
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (10)..(10): Cyclohexyl-Gly
  MOD_RES (11)..(11): Alpha-Me S5-pentenyl-alanine olefin amino acid connected by an all-carbon crosslinker comprising one double bond
  C-term NH2
LTFAAYWAQGAS

SEQ ID NO: 1450 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWVALAS

SEQ ID NO: 1451 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEHWAALAA

SEQ ID NO: 1452 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEYWAALAS

SEQ ID NO: 1453 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWVALAA

SEQ ID NO: 1454 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ITFAEHWAALAS

SEQ ID NO: 1455 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1456 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAEYWAQLAS

SEQ ID NO: 1457 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWLQLAS

SEQ ID NO: 1458 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWLQLAS

SEQ ID NO: 1459 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEHWLQLAS

SEQ ID NO: 1460 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAVYWAQLAS

SEQ ID NO: 1461 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWSQLAS

SEQ ID NO: 1462 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
ETFAAYWAQLAS

SEQ ID NO: 1463 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAEYWAQLAS

SEQ ID NO: 1464 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHAm
LTFAHYWAQLAS

SEQ ID NO: 1465 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHiAm
LTFAHYWAQLAS

SEQ ID NO: 1466 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr3Ph
LTFAHYWAQLAS

SEQ ID NO: 1467 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu3,3Me
LTFAHYWAQLAS

SEQ ID NO: 1468 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnBu
LTFAHYWAQLAS

SEQ ID NO: 1469 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnPr
LTFAHYWAQLAS

SEQ ID NO: 1470 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHnEt2Ch
LTFAHYWAQLAS

SEQ ID NO: 1471 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHHex
LTFAHYWAQLAS

SEQ ID NO: 1472 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAS

SEQ ID NO: 1473 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NHmdPeg2
LTFAAYWAQLAA

SEQ ID NO: 1474 - protein, 12 aa, Artificial Sequence
  Description of Artificial Sequence: Synthetic peptide
  N-term Ac
  MOD_RES (4)..(4): Alpha-Me R5-pentenyl-alanine olefin amino acid connected by an all-carbon crosslinker comprising one double bond
  misc_feature (4)..(11): Crosslink between residues
  MOD_RES (11)..(11): Alpha-Me S8-octenyl-alanine olefin amino acid connected by an all-carbon crosslinker comprising one double bond
  C-term NH2
LTFAAYWAALAS

SEQ ID NO: 1475 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1476 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1477 - protein, 12 aa, Artificial Sequence
  Description of Artificial Sequence: Synthetic peptide
  N-term Ac
  MOD_RES (1)..(1): Cou
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1478 - protein, 12 aa, Artificial Sequence
  Description of Artificial Sequence: Synthetic peptide
  N-term H
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAA

SEQ ID NO: 1479 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
HHFAAYWAQLAS

SEQ ID NO: 1480 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAAYWSQLAS

SEQ ID NO: 1481 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou
  MOD_RES (11)..(11): Alpha-Me S5-pentenyl-alanine olefin amino acid connected by an all-carbon crosslinker comprising one double bond
  C-term NH2
LTFAHXWAQLAS

SEQ ID NO: 1482 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (8)..(8): Cou2
  MOD_RES (11)..(11): Alpha-Me S5-pentenyl-alanine olefin amino acid connected by an all-carbon crosslinker comprising one double bond
  C-term NH2
LTFAAYWXQLAS

SEQ ID NO: 1483 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (5)..(5): Cou2
  MOD_RES (11)..(11): Alpha-Me S5-pentenyl-alanine olefin amino acid connected by an all-carbon crosslinker comprising one double bond
  C-term NH2
LTFAXYWAQLAS

SEQ ID NO: 1484 - protein, 12 aa, Artificial Sequence
  Description of Artificial Sequence: Synthetic peptide
  N-term Ac
  MOD_RES (1)..(1): Cou2
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
XTFAAYWAQLAS

SEQ ID NO: 1485 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (6)..(6): Cou2
  MOD_RES (11)..(11): Alpha-Me S5-pentenyl-alanine olefin amino acid connected by an all-carbon crosslinker comprising one double bond
  C-term NH2
LTFAAXWAQLAS

SEQ ID NO: 1486 - protein, 12 aa, Artificial Sequence
  Description of Artificial Sequence: Synthetic peptide
  N-term Dmaac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1487 - protein, 12 aa, Artificial Sequence
  Description of Artificial Sequence: Synthetic peptide
  N-term Hexac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1488 - protein, 12 aa, Artificial Sequence
  Description of Artificial Sequence: Synthetic peptide
  N-term Napac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1489 - protein, 12 aa, Artificial Sequence
  Description of Artificial Sequence: Synthetic peptide
  N-term Pam
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTFAAYWAQLAS

SEQ ID NO: 1490 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQLAS

SEQ ID NO: 1491 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid that is not connected by a crosslinker
  MOD_RES (11)..(11): Alpha-Me S5-pentenyl-alanine olefin amino acid that is not connected by a crosslinker
  C-term NH2
LTAAHYWAQLAS

SEQ ID NO: 1492 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYFAQLAS

SEQ ID NO: 1493 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHWAAQLAS

SEQ ID NO: 1494 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAWQLAS

SEQ ID NO: 1495 - protein, 12 aa, Artificial Sequence
  Description of Artificial Sequence: Synthetic peptide
  N-term Ac
  MOD_RES (3)..(3): 2-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYAAQWAS

SEQ ID NO: 1496 - protein, 12 aa, Artificial Sequence
  Description of Artificial Sequence: Synthetic peptide
  N-term Ac
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTWAHYWAQLAS

SEQ ID NO: 1497 - protein, 12 aa, Artificial Sequence
  Description of Artificial Sequence: Synthetic peptide
  N-term Ac
  MOD_RES (3)..(3): 1-Naphthalanine
  MOD_RES (4)..(4): Alpha-Me R8-octenyl-alanine olefin amino acid connected by an all-carbon crosslinker comprising one double bond
  misc_feature (4)..(11): Crosslink between residues
  MOD_RES (11)..(11): Alpha-Me S5-pentenyl-alanine olefin amino acid connected by an all-carbon crosslinker comprising one double bond
  C-term NH2
LTAAHYWAQLAS

SEQ ID NO: 1498 - protein, 12 aa, Artificial Sequence
  Description of Artificial Sequence: Synthetic peptide
  N-term Ac
  MOD_RES (1)..(12): D-amino acid
  C-term NH2
TAWYANFEKLLR

SEQ ID NO: 1499 - protein, 12 aa, Artificial Sequence
  Description of Artificial Sequence: Synthetic peptide
  N-term Ac
  MOD_RES (1)..(6): D-amino acid
  MOD_RES (7)..(7): D-Phe-4CF3
  MOD_RES (8)..(12): D-amino acid
  C-term NH2
TAWYANFEKLLR

SEQ ID NO: 1500 - protein, 17 aa, Artificial Sequence
  Description of Artificial Sequence: Synthetic peptide
  N-term Ac
  MOD_RES (4)..(4): Alpha-Me R6-hexynyl-alanine alkynyl amino acids, crosslink via a dialkyne bond with a second alkynyl amino acid
  misc_feature (4)..(11): Crosslink between residues
  MOD_RES (11)..(11): Alpha-Me S6-hexynyl-alanine alkynyl amino acids, crosslink via a dialkyne bond with a second alkynyl amino acid
  MOD_RES (17)..(17): D-amino acid
  C-term NH2
  see specification as filed for detailed description of substitutions and preferred embodiments
LTFAEYWAQLAAAAAAA

SEQ ID NO: 1501 - protein, 6 aa, Artificial Sequence
  Description of Artificial Sequence: Synthetic 6xHis tag
HHHHHH

SEQ ID NO: 1502 - protein, 10 aa, Artificial Sequence
  Description of Artificial Sequence: Synthetic peptide
  N-term Ac
  MOD_RES (2)..(2): Alpha-Me R8-octenyl-alanine olefin amino acid connected by an all-carbon crosslinker comprising one double bond
  misc_feature (2)..(9): Crosslink between residues
  MOD_RES (4)..(4): pmpEt
  MOD_RES (5)..(5): 6clW
  MOD_RES (9)..(9): Alpha-Me S5-pentenyl-alanine olefin amino acid connected by an all-carbon crosslinker comprising one double bond
  C-term NH2
FAAXWEALAA

---

What is claimed is:

1. A peptidomimetic macrocycle comprising an amino acid sequence which is at least about 90% identical to an amino acid sequence selected from the group consisting of SEQ ID NOs: 10-457, wherein the peptidomimetic macrocycle has the formula:

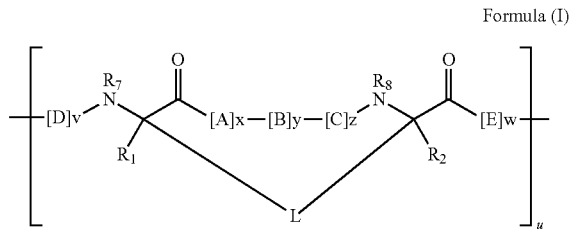

Formula (I)

or a pharmaceutically acceptable salt thereof, wherein:

each A, C, D, and E is independently an amino acid;

each B is independently an amino acid,

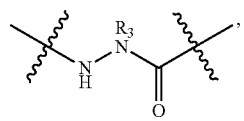

[NH-$L_3$-CO—], [—NH-$L_3$-$SO_2$—], or [—NH-$L_3$-];

each $R_1$ is independently hydrogen, alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each $R_2$ is independently alkyl, alkenyl, alkynyl, arylalkyl, cycloalkyl, cycloalkylalkyl, heteroalkyl, or heterocycloalkyl, unsubstituted or substituted with halo-; or forms a macrocycle-forming linker L' connected to the alpha position of one of said D or E amino acids;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each L and L' is independently a macrocycle-forming linker of the formula -$L_1$-$L_2$-;

each L₁ and L₂ and L₃ is independently alkylene, alkenylene, alkynylene, heteroalkylene, cycloalkylene, heterocycloalkylene, arylene, heteroarylene, or [—R₄-K-R₄-]ₙ, each being optionally substituted with R₅;

each R₄ is independently alkylene, alkenylene, alkynylene, heteroalkylene, cycloalkylene, or heterocycloalkylene;

each K is independently O, SO, SO₂, CO, CO₂, or CONR₃;

each R₅ is independently halogen, alkyl, —OR₆, —N(R₆)₂, —SR₆, —SOR₆, —SO₂R₆, —CO₂R₆, a fluorescent moiety, a radioisotope or a therapeutic agent;

each R₆ is independently hydrogen, alkyl, alkenyl, alkynyl, arylalkyl, cycloalkylalkyl, heterocycloalkyl, a fluorescent moiety, a radioisotope or a therapeutic agent;

each R₇ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R₅, or part of a cyclic structure with a D residue;

each R₈ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with R₅, or part of a cyclic structure with an E residue;

each v is independently an integer from 1-1000;
each w is independently an integer from 1-1000;
u is an integer from 1-10;
each x, y and z is independently an integer from 0-10; and
each n is independently an integer from 1-5;

wherein a first C-terminal amino acid represented by E comprises a hydrophobic side chain, or when a w>1 a first or a second C-terminal amino acid represented by E comprises a hydrophobic side chain; and wherein the peptidomimetic macrocycle or pharmaceutically acceptable salt thereof is not any of SEQ ID NOs: 728, 729, 737-740, 826, 828, 839-841, 857, 860, 864, 866, 868, 872, 881, 884, 897, 911, 914, 915, 920, 921, 923, 926-942, 960-973, 975-977, 1013-1016, 1069, 1070, 1076, 1088, 1089, 1095-1124, 1127-1132, 1136-1139, 1142, 1144, 1149-1151, 1172, 1173, 1178-1201, 1206-1210, 1214-1216, 1246-1252, 1256-1266, 1270, 1272-1278, 1284, 1288, 1289, 1295-1297, 1327, 1336-1339, 1344, 1345, 1360, 1362, 1363, 1369, 1378-1380, 1391, 1392, 1419-1421, 1430, 1431, 1434, 1436, 1438, 1451, 1453, 1473, 1478, or 1502.

2. The peptidomimetic macrocycle or pharmaceutically acceptable salt thereof of claim 1, wherein a first C-terminal amino acid represented by E comprises a hydrophobic side chain.

3. The peptidomimetic macrocycle or pharmaceutically acceptable salt thereof of claim 1, wherein w>1.

4. The peptidomimetic macrocycle or pharmaceutically acceptable salt thereof of claim 3, wherein a first C-terminal amino acid represented by E comprises a hydrophobic side chain.

5. The peptidomimetic macrocycle or pharmaceutically acceptable salt thereof of claim 4, wherein a second C-terminal amino acid represented by E comprises a hydrophobic side chain.

6. The peptidomimetic macrocycle or pharmaceutically acceptable salt thereof of claim 3, wherein a second C-terminal amino acid represented by E comprises a hydrophobic side chain.

7. The peptidomimetic macrocycle or pharmaceutically acceptable salt thereof of claim 1, wherein w>3 and each of a two first amino acids represented by E is independently an amino acid comprising an uncharged side chain or an amino acid comprising a negatively charged side chain.

8. The peptidomimetic macrocycle or pharmaceutically acceptable salt thereof of claim 1, wherein the hydrophobic side chain is a small hydrophobic side chain.

9. The peptidomimetic macrocycle or pharmaceutically acceptable salt thereof of claim 1, wherein each R₄ is independently alkylene, alkenylene, or alkynylene; and wherein each K is independently O, CO, CO₂, or CONR₃.

10. The peptidomimetic macrocycle or pharmaceutically acceptable salt thereof of claim 1, wherein the peptidomimetic macrocycle or pharmaceutically acceptable salt thereof does not include a thioether.

11. The peptidomimetic macrocycle or pharmaceutically acceptable salt thereof of claim 1, wherein the peptidomimetic macrocycle or pharmaceutically acceptable salt thereof comprises an amino acid sequence which is at least about 95% identical to an amino acid sequence selected from the group consisting of SEQ ID NOs: 10-457.

12. The peptidomimetic macrocycle or pharmaceutically acceptable salt thereof of claim 1, wherein each L₁ and L₂ and L₃ is independently alkylene, alkenylene, alkynylene, heteroalkylene, cycloalkylene, heterocycloalkylene, arylene, or heteroarylene, each being optionally substituted with R₅.

13. The peptidomimetic macrocycle or pharmaceutically acceptable salt thereof of claim 1, wherein each L₁ and L₂ and L₃ is independently alkylene or alkenylene.

14. The peptidomimetic macrocycle or pharmaceutically acceptable salt thereof of claim 1, wherein each L is independently alkylene, alkenylene, or alkynylene.

15. The peptidomimetic macrocycle or pharmaceutically acceptable salt thereof of claim 14, wherein each L is independently C₃-C₁₆ alkylene, alkenylene, or alkynylene.

16. The peptidomimetic macrocycle or pharmaceutically acceptable salt thereof of claim 15, wherein each L is independently C₁₀-C₁₄ alkylene, alkenylene, or alkynylene.

17. The peptidomimetic macrocycle or pharmaceutically acceptable salt thereof of claim 1, wherein each R₁ is independently hydrogen, alkyl, alkenyl, alkynyl, arylalkyl, cycloalkyl, cycloalkylalkyl, heteroalkyl, or heterocycloalkyl, unsubstituted or substituted with halo-; and each R₂ is independently alkyl, alkenyl, alkynyl, arylalkyl, cycloalkyl, cycloalkylalkyl, heteroalkyl, or heterocycloalkyl, unsubstituted or substituted with halo-.

18. The peptidomimetic macrocycle or pharmaceutically acceptable salt thereof of claim 17, wherein R₁ is hydrogen.

19. The peptidomimetic macrocycle or pharmaceutically acceptable salt thereof of claim 17, wherein each R₁ and R₂ is independently alkyl.

20. The peptidomimetic macrocycle or pharmaceutically acceptable salt thereof of claim 19, wherein R₁ and R₂ are methyl.

21. The peptidomimetic macrocycle or pharmaceutically acceptable salt thereof of claim 1, wherein x+y+z=6.

22. The peptidomimetic macrocycle or pharmaceutically acceptable salt thereof of claim 1, wherein u is 1.

23. A pharmaceutical composition comprising the peptidomimetic macrocycle or pharmaceutically acceptable salt thereof of claim 1.

24. The pharmaceutical composition of claim 23, wherein the pharmaceutical composition is a liquid composition.

25. A method of treating cancer in a subject comprising administering to the subject a therapeutically-effective amount of a peptidomimetic macrocycle or pharmaceutically acceptable salt thereof of claim 1.

26. The method of claim 25, wherein the cancer is selected from the group consisting of head and neck cancer, melanoma, lung cancer, breast cancer, and glioma.

27. A method of modulating the activity of p53 and/or MDM2 and/or MDMX in a subject comprising administering to the subject a therapeutically-effective amount of a peptidomimetic macrocycle or pharmaceutically acceptable salt thereof of claim 1.

28. A method of antagonizing an interaction between p53 and MDM2 proteins and/or between p53 and MDMX proteins in a subject comprising administering to the subject a therapeutically-effective amount of a peptidomimetic macrocycle or pharmaceutically acceptable salt thereof of claim 1.

29. A method of preparing a composition comprising a peptidomimetic macrocycle of Formula (Ia):

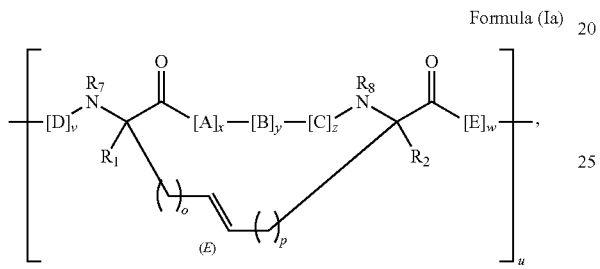

Formula (Ia)

or a pharmaceutically acceptable salt thereof,
comprising an amino acid sequence which is 95% to 100% identical to an amino acid sequence selected from the group consisting of SEQ ID NOs: 10-457, the method comprising treating a compound of Formula (II):

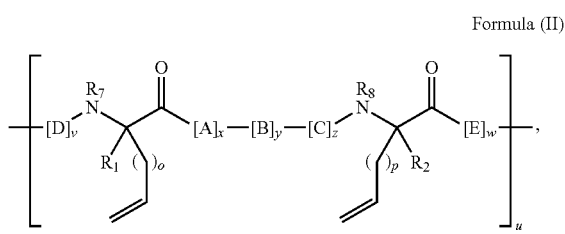

Formula (II)

or a pharmaceutically acceptable salt thereof,
with a catalyst to result in the compound of Formula (Ia) or pharmaceutically acceptable salt thereof;
wherein in the compound of Formula (Ia) or pharmaceutically acceptable salt thereof and in the compound of Formula (II) or pharmaceutically acceptable salt thereof:
each A, C, D, and E is independently an amino acid;
each B is independently an amino acid

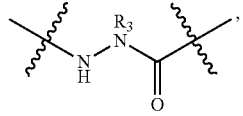

[—NH-$L_3$-CO—], [—NH-$L_3$-$SO_2$—], or [—NH-$L_3$-];
each $R_1$ is independently hydrogen, alkyl, alkenyl, alkynyl, arylalkyl, cycloalkyl, cycloalkylalkyl, heteroalkyl, or heterocycloalkyl, unsubstituted or substituted with halogen; or forms a macrocycle-forming linker L' connected to the alpha position of one of the D or E amino acids;

each $R_2$ is independently alkyl, alkenyl, alkynyl, arylalkyl, cycloalkyl, cycloalkylalkyl, heteroalkyl, or heterocycloalkyl, unsubstituted or substituted with halogen; or forms a macrocycle-forming linker L' connected to the alpha position of one of the D or E amino acids;

each $R_3$ is independently hydrogen, alkyl, alkenyl, alkynyl, arylalkyl, heteroalkyl, cycloalkyl, heterocycloalkyl, cycloalkylalkyl, aryl, or heteroaryl, optionally substituted with $R_5$;

each L' is independently a macrocycle-forming linker of the formula -$L_1$-$L_2$-;

each $L_1$ and $L_2$ and $L_3$ is independently alkylene, alkenylene, alkynylene, heteroalkylene, cycloalkylene, heterocycloalkylene, arylene, heteroarylene, or [—$R_4$-K-$R_{4'}$-]$_n$, each being optionally substituted with $R_5$;

each $R_4$ and $R_{4'}$ is independently alkylene, alkenylene, alkynylene, heteroalkylene, cycloalkylene, or heterocycloalkylene;

each K is independently O, SO, $SO_2$, CO, $CO_2$, or $CONR_3$;

each $R_5$ is independently halogen, alkyl, —$OR_6$, —$N(R_6)_2$, —$SR_6$, —$SOR_6$, —$SO_2R_6$, —$CO_2R_6$, a fluorescent moiety, a radioisotope or a therapeutic agent;

each $R_6$ is independently hydrogen, alkyl, alkenyl, alkynyl, arylalkyl, cycloalkylalkyl, heterocycloalkyl, a fluorescent moiety, a radioisotope or a therapeutic agent;

each $R_7$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with a D residue;

each $R_8$ is independently hydrogen, alkyl, alkenyl, alkynyl, arylalkyl, cycloalkyl, heteroalkyl, cycloalkylalkyl, heterocycloalkyl, aryl, or heteroaryl, optionally substituted with $R_5$, or part of a cyclic structure with an E residue;

each v is independently an integer from 1-1000;
each w is independently an integer from 1-1000;
u is an integer from 1-10;
each x, y and z is independently an integer from 0-10;
each n is independently an integer from 1-5;
each o is independently an integer from 1 to 15;
each p is independently an integer from 1 to 15;
(E) represents a trans double bond or an E-double bond; and
one or more of A, B, and C has a side chain bearing a protecting group;
wherein a first C-terminal amino acid represented by E comprises a hydrophobic side chain, or when a w>1 a first or a second C-terminal amino acid represented by E comprises a hydrophobic side chain; and
wherein the peptidomimetic macrocycle or pharmaceutically acceptable salt thereof is not any of SEQ ID NOs: 728, 729, 737-740, 826, 828, 839-841, 857, 860, 864, 866, 868, 872, 881, 884, 897, 911, 914, 915, 920, 921, 923, 926-942, 960-973, 975-977, 1013-1016, 1069, 1070, 1076, 1088, 1089, 1095-1124, 1127-1132, 1136-1139, 1142, 1144, 1149-1151, 1172, 1173, 1178-1201, 1206-1210, 1214-1216, 1246-1252, 1256-1266, 1270, 1272-1278, 1284, 1288, 1289, 1295-1297, 1327, 1336-1339, 1344, 1345, 1360, 1362, 1363, 1369, 1378-1380, 1391, 1392, 1419-1421, 1430, 1431, 1434, 1436, 1438, 1451, 1453, 1473, 1478 or 1502.

30. The method of claim 29, wherein the protecting group is a nitrogen atom protecting group.

31. The method of claim 29, wherein the protecting group is a Boc group.

32. The method of claim 30, wherein the side chain bearing the protecting group comprises a protected indole.

33. The method of claim 32, wherein the protecting group is borne on the side chain of a tryptophan (W) that is protected by the protecting group on its indole nitrogen.

34. The method of claim 33, wherein the protecting group is borne on the side chain of a tryptophan (W) that is protected on its indole nitrogen by a Boc group.

35. The method of claim 29, wherein after the step of treating the compound of Formula (II) or pharmaceutically acceptable salt thereof with the catalyst, the compound of Formula (Ia) or pharmaceutically acceptable salt thereof is obtained in an amount equal or higher than an amount obtained of a corresponding compound or pharmaceutically acceptable salt thereof which is a Z isomer.

36. The method of claim 35, wherein after the contacting the compound of Formula (II) or pharmaceutically acceptable salt thereof with the catalyst, the compound of Formula (Ia) or pharmaceutically acceptable salt thereof is obtained in an amount that is 2, 3, 4, 5, 6, 7, 8, 9, or 10-fold higher than an amount obtained of the corresponding compound or pharmaceutically acceptable salt thereof which is the Z isomer.

37. The method of claim 29, wherein the catalyst is a ruthenium catalyst.

38. The method of claim 29, further comprising the step of treating the compound of Formula (Ia) or pharmaceutically acceptable salt thereof with a reducing agent or an oxidizing agent.

39. The method of claim 29, wherein the compound of Formula (II) or pharmaceutically acceptable salt thereof is attached to a solid support.

40. The method of claim 29, wherein the compound of Formula (II) or pharmaceutically acceptable salt thereof is not attached to a solid support.

41. The method of claim 29, further comprising removing the protecting group from the compound of Formula (Ia) or pharmaceutically acceptable salt thereof.

42. The method of claim 29, wherein the treating is conducted at a temperature ranging from about 20° C. to about 80° C.

43. The method of claim 29, wherein the peptidomimetic macrocycle of Formula (Ia) or pharmaceutically acceptable salt thereof comprises an α-helix.

44. The peptidomimetic macrocycle or pharmaceutically acceptable salt thereof of claim 1, wherein each L is independently alkenylene.

45. The peptidomimetic macrocycle or pharmaceutically acceptable salt thereof of claim 1, wherein w is 3-10.

46. The peptidomimetic macrocycle or pharmaceutically acceptable salt thereof of claim 45, wherein w is 3-6.

47. The peptidomimetic macrocycle or pharmaceutically acceptable salt thereof of claim 45, wherein w is 6-10.

48. The peptidomimetic macrocycle or pharmaceutically acceptable salt thereof of claim 45, wherein w is 6.

49. The peptidomimetic macrocycle or pharmaceutically acceptable salt thereof of claim 45, wherein w is 3.

50. The peptidomimetic macrocycle or pharmaceutically acceptable salt thereof of claim 1, wherein v is 1-10.

51. The peptidomimetic macrocycle or pharmaceutically acceptable salt thereof of claim 50, wherein v is 3-10.

52. The peptidomimetic macrocycle or pharmaceutically acceptable salt thereof of claim 51, wherein v is 3-5.

53. The peptidomimetic macrocycle or pharmaceutically acceptable salt thereof of claim 52, wherein v is 3.

54. The peptidomimetic macrocycle or pharmaceutically acceptable salt thereof of claim 53, wherein $[D]_v$ is $Leu_1$-$Thr_2$-Xaa, wherein Xaa is independently an amino acid.

55. The peptidomimetic macrocycle or pharmaceutically acceptable salt thereof of claim 1, wherein each w is independently 1-10 and v is 3.

56. The peptidomimetic macrocycle or pharmaceutically acceptable salt thereof of claim 1, wherein each v is independently 1-10 and w is 3.

57. The peptidomimetic macrocycle or pharmaceutically acceptable salt thereof of claim 1, wherein each v is independently 1-10 and w is 6.

58. The peptidomimetic macrocycle or pharmaceutically acceptable salt thereof of claim 1, wherein v is 3 and w is 3.

59. The peptidomimetic macrocycle or pharmaceutically acceptable salt thereof of claim 1, wherein v is 3 and w is 6.

60. The peptidomimetic macrocycle or pharmaceutically acceptable salt thereof of claim 21, wherein each w is independently 1-10 and v is 3.

61. The peptidomimetic macrocycle or pharmaceutically acceptable salt thereof of claim 21, wherein each v is independently 1-10 and w is 3.

62. The peptidomimetic macrocycle or pharmaceutically acceptable salt thereof of claim 21, wherein each v is independently 1-10 and w is 6.

63. The peptidomimetic macrocycle or pharmaceutically acceptable salt thereof of claim 21, wherein v is 3 and w is 3.

64. The peptidomimetic macrocycle or pharmaceutically acceptable salt thereof of claim 21, wherein v is 3 and w is 6.

65. The peptidomimetic macrocycle or pharmaceutically acceptable salt thereof of claim 22, wherein each w is independently 1-10 and v is 3.

66. The peptidomimetic macrocycle or pharmaceutically acceptable salt thereof of claim 22, wherein each v is independently 1-10 and w is 3.

67. The peptidomimetic macrocycle or pharmaceutically acceptable salt thereof of claim 22, wherein each v is independently 1-10 and w is 6.

68. The peptidomimetic macrocycle or pharmaceutically acceptable salt thereof of claim 22, wherein v is 3 and w is 3.

69. The peptidomimetic macrocycle or pharmaceutically acceptable salt thereof of claim 22, wherein v is 3 and w is 6.

70. The peptidomimetic macrocycle or pharmaceutically acceptable salt thereof of claim 1, wherein w is 3, v is 3, u is 1, and x+y+z is 6.

71. The peptidomimetic macrocycle or pharmaceutically acceptable salt thereof of claim 1, wherein w is 6, v is 3, u is 1, and x+y+z is 6.

* * * * *